(12) United States Patent
Swanson et al.

(10) Patent No.: US 12,065,476 B2
(45) Date of Patent: Aug. 20, 2024

(54) PD-1 VARIANT IMMUNOMODULATORY PROTEINS AND USES THEREOF

(71) Applicant: Alpine Immune Sciences, Inc., Seattle, WA (US)

(72) Inventors: Ryan Swanson, Seattle, WA (US); Daniel William Demonte, Seattle, WA (US)

(73) Assignee: Alpine Immune Sciences, Inc., Seattle, WA (US)

( * ) Notice: Subject to any disclaimer, the term of this patent is extended or adjusted under 35 U.S.C. 154(b) by 620 days.

(21) Appl. No.: 17/252,233

(22) PCT Filed: Jun. 14, 2019

(86) PCT No.: PCT/US2019/037388
§ 371 (c)(1),
(2) Date: Dec. 14, 2020

(87) PCT Pub. No.: WO2019/241758
PCT Pub. Date: Dec. 19, 2019

(65) Prior Publication Data
US 2021/0363219 A1 Nov. 25, 2021

Related U.S. Application Data

(60) Provisional application No. 62/774,145, filed on Nov. 30, 2018, provisional application No. 62/753,886, filed on Oct. 31, 2018, provisional application No. 62/685,880, filed on Jun. 15, 2018.

(51) Int. Cl.
| | |
|---|---|
| *C07K 14/00* | (2006.01) |
| *C07K 14/705* | (2006.01) |
| *C07K 16/28* | (2006.01) |
| *C12N 15/86* | (2006.01) |
| *A61K 38/00* | (2006.01) |

(52) U.S. Cl.
CPC .... *C07K 14/70521* (2013.01); *C07K 16/2818* (2013.01); *C12N 15/86* (2013.01); *A61K 38/00* (2013.01); *C07K 2317/53* (2013.01); *C07K 2319/03* (2013.01)

(58) Field of Classification Search
CPC .......... C07K 14/70521; C07K 16/2818; C07K 2317/53; C07K 2319/03; C12N 15/86; A61K 38/00
See application file for complete search history.

(56) References Cited

U.S. PATENT DOCUMENTS

| | | |
|---|---|---|
| 5,168,062 A | 12/1992 | Stinski |
| 5,208,020 A | 5/1993 | Chari et al. |
| 5,385,839 A | 1/1995 | Stinski |
| 5,443,964 A | 8/1995 | Pickup et al. |
| 5,500,362 A | 3/1996 | Robinson et al. |
| 5,624,821 A | 4/1997 | Winter et al. |
| 5,648,260 A | 7/1997 | Winter et al. |
| 5,698,530 A | 12/1997 | Schlom et al. |
| 5,716,613 A | 2/1998 | Guber et al. |
| 5,716,826 A | 2/1998 | Guber et al. |
| 5,731,168 A | 3/1998 | Carter et al. |
| 5,767,071 A | 6/1998 | Palladino et al. |
| 5,780,426 A | 7/1998 | Palladino et al. |
| 5,821,337 A | 10/1998 | Carter et al. |
| 5,851,529 A | 12/1998 | Guber et al. |
| 5,891,432 A | 4/1999 | Hoo |
| 5,998,205 A | 12/1999 | Hallenbeck et al. |
| 6,143,290 A | 11/2000 | Zhang et al. |
| 6,194,551 B1 | 2/2001 | Idusogie et al. |
| 6,365,619 B1 | 4/2002 | Shi |
| 6,428,968 B1 | 8/2002 | Molnar-Kimber et al. |
| 6,596,535 B1 | 7/2003 | Carter |
| 6,632,670 B1 | 10/2003 | Wadsworth et al. |
| 6,635,472 B1 | 10/2003 | Lauermann |
| 6,653,103 B2 | 11/2003 | Peterson et al. |
| 6,689,871 B1 | 2/2004 | Wolfe et al. |
| 6,723,316 B2 | 4/2004 | Laquerre et al. |
| 6,737,056 B1 | 5/2004 | Presta |
| 6,855,317 B2 | 2/2005 | Koelle et al. |
| 6,887,471 B1 | 5/2005 | Linsley et al. |
| 6,897,045 B2 | 5/2005 | Engelhardt et al. |
| 6,936,257 B1 | 8/2005 | Bennett |
| 6,998,252 B1 | 2/2006 | Moss et al. |
| 7,001,765 B2 | 2/2006 | Maass et al. |

(Continued)

FOREIGN PATENT DOCUMENTS

| | | |
|---|---|---|
| EP | 0757099 | 2/1997 |
| EP | 1385466 | 2/2004 |

(Continued)

OTHER PUBLICATIONS

"Database accession No. A0A2K5E9H6," Retrieved from UNIPROT, https://www.uniprot.org/uniprot/A0A2K5E9H6. Retrieved Sep. 13, 2019.
"Database accession No. AER57743 Human B7Rp1 extracellular domain (ECD)" Dated Apr. 19, 2007.
"Database accession No. BDH56778", Retrieved from GENESEQ, Retrieved on Sep. 13, 2019.
"Database accession No. BDV07959," Retrieved from GENESEQ, Retrieved on Sep. 12, 2019.
"Database accession No. ADM18706." Retrieved from IBIS, http://ibis/exam/dbfetch.jsp?id=GSP:ADM18706. Retrieved on Oct. 10, 2017.
"Database accession No. ADM18913." Retrieved from IBIS, http://ibis/exam/dbfetch.jsp?id=GSP:ADM18913. Retrieved on Oct. 10, 2017.

(Continued)

*Primary Examiner* — Jeanette M Lieb
(74) *Attorney, Agent, or Firm* — Morrison & Foerster LLP

(57) ABSTRACT

Provided herein are immunomodulatory proteins comprising variant PD-1 polypeptides, nucleic acids encoding such proteins and engineered cells expressing such proteins. The immunomodulatory proteins provide therapeutic utility for a variety of immunological and oncological conditions. Compositions and methods for making and using such proteins are provided.

11 Claims, 23 Drawing Sheets

Specification includes a Sequence Listing.

(56) References Cited

U.S. PATENT DOCUMENTS

| | | |
|---|---|---|
| 7,033,826 B2 | 4/2006 | Perricaudet et al. |
| 7,094,875 B2 | 8/2006 | Punnonen et al. |
| 7,125,717 B2 | 10/2006 | Carter |
| 7,153,510 B1 | 12/2006 | Rose |
| 7,172,893 B2 | 2/2007 | Rabinowitz et al. |
| 7,238,526 B2 | 7/2007 | Wilson et al. |
| 7,241,447 B1 | 7/2007 | Engelhardt et al. |
| 7,247,615 B2 | 7/2007 | Schlom et al. |
| 7,332,581 B2 | 2/2008 | Presta |
| 7,368,116 B2 | 5/2008 | Schlom et al. |
| 7,371,826 B2 | 5/2008 | Presta |
| 7,378,087 B2 | 5/2008 | Jefferies et al. |
| 7,537,924 B2 | 5/2009 | Coffin |
| 7,550,296 B2 | 6/2009 | Hermiston et al. |
| 7,588,767 B2 | 9/2009 | Szalay et al. |
| 7,588,771 B2 | 9/2009 | Szalay et al. |
| 7,662,398 B2 | 2/2010 | Szalay et al. |
| 7,662,627 B2 | 2/2010 | Johnson et al. |
| 7,709,214 B2 | 5/2010 | Freeman et al. |
| 7,731,952 B2 | 6/2010 | Mohr et al. |
| 7,731,974 B2 | 6/2010 | Bell et al. |
| 7,754,221 B2 | 7/2010 | Szalay et al. |
| 7,811,814 B2 | 10/2010 | Bohn et al. |
| 7,897,146 B2 | 3/2011 | Brown et al. |
| 7,906,111 B2 | 3/2011 | Wilson et al. |
| 7,927,585 B2 | 4/2011 | Snyder |
| 7,943,374 B2 | 5/2011 | Hildinger |
| 7,968,340 B2 | 6/2011 | Hallek et al. |
| 8,007,780 B2 | 8/2011 | Arbetman et al. |
| 8,911,726 B2 | 12/2014 | Takahashi et al. |
| 8,956,619 B2 | 2/2015 | Ostrand-Rosenberg |
| 9,103,831 B2 | 8/2015 | O'Sullivan et al. |
| 9,453,227 B2 | 9/2016 | Diamond et al. |
| 9,562,087 B2 | 2/2017 | Ring et al. |
| 10,588,938 B2 | 3/2020 | Glaccia et al. |
| 2002/0168714 A1 | 11/2002 | Barbas et al. |
| 2003/0138881 A1 | 7/2003 | Punnonen et al. |
| 2003/0158102 A1 | 8/2003 | Chen et al. |
| 2004/0009604 A1 | 1/2004 | Zhang et al. |
| 2004/0063094 A1 | 4/2004 | Coffin et al. |
| 2004/0146488 A1 | 7/2004 | Hu et al. |
| 2005/0014934 A1 | 1/2005 | Hinton et al. |
| 2005/0220818 A1 | 10/2005 | Lorence |
| 2005/0260601 A1 | 11/2005 | Whitt et al. |
| 2006/0039894 A1 | 2/2006 | Mohr et al. |
| 2007/0098743 A1 | 5/2007 | Bell et al. |
| 2007/0110720 A1 | 5/2007 | Brown et al. |
| 2007/0202572 A1 | 8/2007 | Szalay et al. |
| 2007/0212727 A1 | 9/2007 | Szalay et al. |
| 2009/0010889 A1 | 1/2009 | Brown et al. |
| 2009/0053244 A1 | 2/2009 | Chen et al. |
| 2009/0098529 A1 | 4/2009 | Chen et al. |
| 2009/0117034 A1 | 5/2009 | Chen et al. |
| 2009/0136917 A1 | 5/2009 | Szalay et al. |
| 2009/0155287 A1 | 6/2009 | Chen et al. |
| 2009/0162288 A1 | 6/2009 | Chen et al. |
| 2009/0215147 A1 | 8/2009 | Zhang et al. |
| 2009/0274728 A1 | 11/2009 | Brown et al. |
| 2009/0285860 A1 | 11/2009 | Martuza et al. |
| 2010/0062016 A1 | 3/2010 | Szalay et al. |
| 2010/0092515 A1 | 4/2010 | Conner et al. |
| 2010/0113567 A1 | 5/2010 | Barber |
| 2010/0136549 A1 | 6/2010 | Christiansen et al. |
| 2010/0172877 A1 | 7/2010 | van den Pol et al. |
| 2010/0178276 A1 | 7/2010 | Sadelain et al. |
| 2010/0178684 A1 | 7/2010 | Woo et al. |
| 2010/0196325 A1 | 8/2010 | Szalay et al. |
| 2010/0233078 A1 | 9/2010 | Szalay et al. |
| 2010/0261660 A1 | 10/2010 | Punnonen et al. |
| 2011/0064650 A1 | 3/2011 | Szalay |
| 2011/0064763 A1 | 3/2011 | Allen et al. |
| 2011/0158948 A1 | 6/2011 | Brown et al. |
| 2011/0159023 A1 | 6/2011 | Langermann |
| 2011/0177032 A1 | 7/2011 | Martuza |
| 2011/0195068 A1 | 8/2011 | Langermann et al. |
| 2011/0212530 A1 | 9/2011 | Baltimore et al. |
| 2011/0293705 A1 | 12/2011 | Irvine et al. |
| 2013/0149305 A1 | 6/2013 | Ostrand-Rosenberg |
| 2013/0287748 A1 | 10/2013 | June et al. |
| 2014/0011370 A1 | 1/2014 | Camphausen |
| 2014/0050708 A1 | 2/2014 | Powell et al. |
| 2014/0099309 A1 | 4/2014 | Powell et al. |
| 2014/0154216 A1 | 6/2014 | Coffin |
| 2014/0186401 A1 | 7/2014 | Diamond et al. |
| 2014/0227237 A1 | 8/2014 | June et al. |
| 2014/0322129 A1 | 10/2014 | Leong et al. |
| 2014/0348832 A1 | 11/2014 | Zhu et al. |
| 2015/0232532 A1 | 8/2015 | Ostrand-Rosenberg |
| 2015/0359909 A1 | 12/2015 | O'Sullivan et al. |
| 2016/0009805 A1 | 1/2016 | Kowanetz et al. |
| 2016/0017041 A1 | 1/2016 | Violette et al. |
| 2016/0339066 A1 | 11/2016 | Szalay et al. |
| 2016/0376346 A1 | 12/2016 | Camphausen |
| 2017/0285037 A1 | 10/2017 | Kuangara et al. |
| 2017/0320959 A1 | 11/2017 | Swanson et al. |
| 2018/0118805 A1 | 5/2018 | Bernett et al. |
| 2018/0244749 A1 | 8/2018 | Swanson et al. |
| 2018/0256644 A1 | 9/2018 | Swanson et al. |
| 2019/0135922 A1 | 5/2019 | Swanson et al. |
| 2019/0175654 A1 | 6/2019 | Swanson et al. |
| 2020/0040059 A1 | 2/2020 | Swanson et al. |
| 2020/0283500 A1 | 9/2020 | Lawrence et al. |
| 2021/0130436 A1 | 5/2021 | Swanson et al. |
| 2021/0155668 A1 | 5/2021 | Swanson et al. |
| 2021/0155669 A1 | 5/2021 | Swanson et al. |

FOREIGN PATENT DOCUMENTS

| | | |
|---|---|---|
| EP | 1391213 | 2/2004 |
| EP | 1520175 | 4/2005 |
| EP | 1606411 | 12/2005 |
| EP | 3020816 | 5/2016 |
| JP | 2013-518900 | 5/2013 |
| WO | WO-1994/029351 | 12/1994 |
| WO | WO-1998/050431 | 11/1998 |
| WO | WO-1999/002711 | 1/1999 |
| WO | WO-1999/038955 | 8/1999 |
| WO | WO-1999/051642 | 10/1999 |
| WO | WO-2000/042072 | 7/2000 |
| WO | WO-2001/030843 | 5/2001 |
| WO | WO-2002/000717 | 1/2002 |
| WO | WO-2004/029197 | 4/2004 |
| WO | WO-2004/056312 | 7/2004 |
| WO | WO-2005/063816 | 7/2005 |
| WO | WO-2005/100402 | 10/2005 |
| WO | WO-2006/019447 | 2/2006 |
| WO | WO-2006/029879 | 3/2006 |
| WO | WO-2007/052029 | 5/2007 |
| WO | WO-2008/011636 | 1/2008 |
| WO | WO-2009/029342 | 3/2009 |
| WO | WO-2009/067800 | 6/2009 |
| WO | WO-2009/076524 | 6/2009 |
| WO | WO-2010/027828 | 3/2010 |
| WO | WO-2011/020024 | 2/2011 |
| WO | WO-2011/056983 | 5/2011 |
| WO | WO 2011/097477 | 8/2011 |
| WO | WO-2011/113019 | 9/2011 |
| WO | WO-2011/133886 | 10/2011 |
| WO | WO 2012/079000 | 6/2012 |
| WO | WO-2012/125850 | 9/2012 |
| WO | WO-2012/141984 | 10/2012 |
| WO | WO-2012/149364 | 11/2012 |
| WO | WO-2013/003761 | 1/2013 |
| WO | WO-2013/130683 | 9/2013 |
| WO | WO-2013/149167 | 10/2013 |
| WO | WO-2013/169338 | 11/2013 |
| WO | WO-2014/198002 | 12/2014 |
| WO | WO-2014/207063 | 12/2014 |
| WO | WO-2015/009606 | 1/2015 |
| WO | WO-2015/107026 | 7/2015 |
| WO | WO-2015/181343 | 12/2015 |
| WO | WO-2016/008976 | 1/2016 |
| WO | WO-2016/011083 | 1/2016 |
| WO | WO-2016/022994 | 2/2016 |

(56) References Cited

FOREIGN PATENT DOCUMENTS

| WO | WO-2016/023001 | | 2/2016 | |
|---|---|---|---|---|
| WO | WO-2016/164428 | | 10/2016 | |
| WO | WO-2016/168771 | | 10/2016 | |
| WO | WO-2016164428 A1 | * | 10/2016 | ......... A61K 38/1774 |
| WO | WO-2017/048878 | | 3/2017 | |
| WO | WO-2017/055547 | | 4/2017 | |
| WO | WO-2017/085307 | | 9/2017 | |
| WO | WO-2017/181148 | | 10/2017 | |
| WO | WO-2017/181152 | | 10/2017 | |
| WO | WO-2017/201131 | | 11/2017 | |
| WO | WO-2018/022945 | | 2/2018 | |
| WO | WO-2018/022946 | | 2/2018 | |
| WO | WO-2018/075978 | | 4/2018 | |
| WO | WO-2018/170021 | | 9/2018 | |
| WO | WO-2018/170026 | | 9/2018 | |
| WO | WO-2019/079520 | | 4/2019 | |
| WO | WO-2019/136179 | | 7/2019 | |
| WO | WO-2019/241758 | | 12/2019 | |
| WO | WO-2020/113141 | | 6/2020 | |

OTHER PUBLICATIONS

"Database accession No. BCD07227." Retrieved from IBIS, http://ibis/exam/dbfetch.jsp?id=GSP:BCD07227. Retrieved on Oct. 10, 2017.
"Database accession No. BCD07228." Retrieved from IBIS, http://ibis/exam/dbfetch.jsp?id=GSP:BCD07228. Retrieved on Oct. 10, 2017.
"Database accession No. H9Z6Y0," version 15. Retrieved from UNISAVE, http://www.ebi.ac.uk/uniprot/unisave/app/#/content/H9Z6Y0/15. Retrieved on Jun. 20, 2017.
"Database accession No. L8Y5K4," version 13. Retrieved from UNISAVE, http://www.ebi.ac.uk/uniprot/unisave/app/#/content/L8Y5K4/13. Retrieved on Sep. 28, 2017.
"Database accession No. G3SBS5" Retrieved from UNIPROT, https://www.uniprot.org/uniprot/G3SBS5.txt. Retrieved on Aug. 12, 2021.
"Database accession No. A0A2K5Q1G1" Retrieved from UNIPROT, https://www.uniprot.org/uniprot/A0A2K5Q1G1.txt. Retrieved on Aug. 12, 2021.
Baban et al., "Bacteria as vectors for gene therapy of cancer," Bioeng Bugs. (2010) 1(6):385-394.
Behr et al., "Trastuzumab and breast cancer," N Engl J Med.(2001) 345:995-996.
Benson et al., "GenBank," Nucleic Acids Res (2013) 41(Database issue):D36-D42.
Brown et al., "Structure-based mutagenesis of the human immunodeficiency virus type 1 DNA attachment site: effects on integration and cDNA synthesis," J Virol. (1999) 73(11):9011-9020.
Bruggemann et al., "Comparison of the effector functions of human immunoglobulins using a matched set of chimeric antibodies," J Exp Med. (1987) 166(5):1351-1361.
Buchschacher et al., "Human immunodeficiency virus vectors for inducible expression of foreign genes," J Virol. (1992) 66(5):2731-2739.
Chakrabarti et al., "A mutant B7-1/Ig fusion protein that selectively binds to CTLA-4 ameliorates anti-tumor DNA vaccination and counters regulatory T cell activity", Vaccine, Elsevier, Amsterdam , NL, vol. 23, No. 37, Aug. 31, 2005 pp. 4553-4564.
Chang et al., "The discovery of small molecule carbamates as potent dual alpha(4)beta(1)/alpha(4)beta(7) integrin antagonists," Bioorg Med Chem Lett. Jan. 21, 2002;12(2):159-63.
Chari et al., "Immunoconjugates containing novel maytansinoids: promising anticancer drugs," Cancer Res. (1992) 52(1):127-131.
Chattopadhyay et al., "Structural basis of inducible costimulator ligand costimulatory function: determination of the cell surface oligomeric state and functional mapping of the receptor binding site of the protein," J Immunol. Sep. 15, 2006;177(6):3920-9.

Clynes et al., "Fc receptors are required in passive and active immunity to melanoma," Proc Natl Acad Sci U S A. (1998) 95(2):652-656.
Cogswell et al., "An Analytical Comparison of Dako 28-8 PharmDx Assay and an E1L3N Laboratory-Developed Test in the Immunohistochemical Detection of Programmed Death-Ligand 1," Mol Diagn Ther (2017) 21(1): 85-93.
Colby et al., "Engineering antibody affinity by yeast surface display," Methods Enzymol. 2004;388:348-58.
Colcher et al., "Use of monoclonal antibodies as radiopharmaceuticals for the localization of human carcinoma xenografts in athymic mice," Methods Enzymol. (1986); 121: 802-16.
Cornetta et al., "No retroviremia or pathology in long-term follow-up of monkeys exposed to a murine amphotropic retrovirus," Hum Gene Ther. (1991) Fall;2(3):215-9.
Cragg et al., "Antibody specificity controls in vivo effector mechanisms of anti-CD20 reagents," Blood. (2004) 103(7):2738-2743.
Cragg et al., "Complement-mediated lysis by anti-CD20 mAb correlates with segregation into lipid rafts," Blood. (2003) 101(3):1045-1052.
David et al., "Protein iodination with solid state lactoperoxidase," Biochemistry. Feb. 26, 1974;13(5):1014-21.
Deisenhofer et al., "Crystallographic refinement and atomic models of a human Fc fragment and its complex with fragment B of protein A from *Staphylococcus aureus* at 2.9- and 2.8-A resolution," Biochemistry. Apr. 28, 1981;20(9):2361-70.
Duncan et al., "The binding site for C1q on IgG," Nature. Apr. 21, 1988;332(6166):738-40.
Engelman et al., "Multiple effects of mutations in human immunodeficiency virus type 1 integrase on viral replication," J Virol. 1995 69(5):2729-2736.
Fraker et al., "Protein and cell membrane iodinations with a sparingly soluble chloroamide, 1,3,4,6-tetrachloro-3a,6a-diphrenylglycoluril," Biochem Biophys Res Commun. Feb. 28, 1978;80(4):849-57.
Garcia-Aragoncillo et al., "Design of virotherapy for effective tumor treatment," Curr Opin Mol Ther. Aug. 2010;12(4):403-11.
Gazzano-Santoro et al., "A non-radioactive complement-dependent cytotoxicity assay for anti-CD20 monoclonal antibody," J Immunol Methods. Mar. 28, 1997;202(2):163-71.
Gherardi et al., "Recombinant poxviruses as mucosal vaccine vectors," J Gen Virol. (2005) 86(Pt 11):2925-2936.
Guerra et al., "Host response to the attenuated poxvirus vector NYVAC: upregulation of apoptotic genes and NF-kappaB-responsive genes in infected HeLa cells," J Virol. (2006) 80(2): 985-98.
Hallden et al., "Oncolytic virotherapy with modified adenoviruses and novel therapeutic targets," Expert Opin Ther Targets. Oct. 2012;16(10):945-58.
Harris et al., "CD80 costimulation is essential for the induction of airway eosinophilia," J Exp Med. Jan. 6, 1997;185(1):177-82.
Hellstrom et al., "Antitumor effects of L6, an IgG2a antibody that reacts with most human carcinomas," Proc Natl Acad Sci U S A. (1986) 83(18):7059-7063.
Hellstrom et al., "Strong antitumor activities of IgG3 antibodies to a human melanoma-associated ganglioside," Proc Natl Acad Sci U S A. (1985) 82(5):1499-1502.
Hinman et al., "Preparation and characterization of monoclonal antibody conjugates of the calicheamicins: a novel and potent family of antitumor antibiotics," Cancer Res. (1993) 53(14):3336-3342.
Hu et al., "Yaba-like disease virus: an alternative replicating poxvirus vector for cancer gene therapy," J Virol. (2001) 75(21):10300-10308.
Hunter et al., "Preparation of iodine-131 labelled human growth hormone of high specific activity," Nature. May 5, 1962;194:495-6.
Idusogie et al., "Mapping of the C1q binding site on rituxan, a chimeric antibody with a human IgG1 Fc," J Immunol. (2000) 164(8):4178-4184.
Johann et al., "GLVR1, a receptor for gibbon ape leukemia virus, is homologous to a phosphate permease of Neurospora crassa and is expressed at high levels in the brain and thymus," J Virol. (1992) 66(3):1635-1640.

(56) References Cited

OTHER PUBLICATIONS

Kabat et al., "Sequences of Proteins of Immunological Interest," Fifth Edition, U.S. Department of Health and Human Services, NIH Publication No. 91-3242 (1991), 83 pages.
Kirn et al., "Targeted and armed oncolytic poxviruses: a novel multi-mechanistic therapeutic class for cancer," Nat Rev Cancer. Jan. 2009;9(1):64-71.
Kolberg, "Gene-transfer virus contaminant linked to monkey's cancer," J NIH Res. (1992) 4:43-44.
Labrijn et al., "Therapeutic IgG4 antibodies engage in Fab-arm exchange with endogenous human IgG4 in vivo," Nat Biotechnol. Aug. 2009;27(8):767-71.
Larsen et al., "Rational development of LEA29Y (belatacept), a high-affinity variant of CTLA4-Ig with potent immunosuppressive properties," Am J Transplant. Mar. 2005;5(3):443-53.
Levin et al., "Switch Transmembrane Immunomodulatory Proteins (TIPs) Consisting of High-Affinity PD-1 Extracellular Domains (PD-1 vIgDs) and Costimulatory Intracellular Domains Potently Enhance the Activity of TCR-Engineered T Cells" Blood (2018) 132 (Supplement 1): 2052.
Levin et al., "Tumor-Localizing PD-1/ICOSL vIgD Fusion Proteins Combine PD-L1 inhibition with Dual CD28/ICOS T Cell Costimulation to Elicit Potent Responses Against PD-L1+ Tumors" Abstract SITC 2018.
Li et al., "Comparison of anti-CD3 and anti-CD28-coated beads with soluble anti-CD3 for expanding human T cells: differing impact on CD8 T cell phenotype and responsiveness to restimulation," J Transl Med. (2010) 8:104.
Lin et al., "Specific and dual antagonists of alpha(4)beta(1) and alpha(4)beta(7) integrins," Bioorg Med Chem Lett. Jan. 21, 2002;12(2):133-6.
Lin et al., "The PD-1/PD-L1 complex resembles the antigen-binding Fv domains of antibodies and T cell receptors," Proc Natl Acad Sci U S A. (2008) 105(8):3011-3016.
Linsley et al., "Human B7-1 (CD80) and B7-2 (CD86) bind with similar avidities but distinct kinetics to CD28 and CTLA-4 receptors," Immunity. (1994) 1(9): 793-801.
Liu et al., "Eradication of large colon tumor xenografts by targeted delivery of maytansinoids," Proc Natl Acad Sci U S A. (1996) 93(16):8618-8623.
Lode et al., "Targeted therapy with a novel enediyene antibiotic calicheamicin theta(I)1 effectively suppresses growth and dissemination of liver metastases in a syngeneic model of murine neuroblastoma," Cancer Res. (1998) 58(14):2925-2928.
Mandler et al., "Immunoconjugates of geldanamycin and anti-HER2 monoclonal antibodies: antiproliferative activity on human breast carcinoma cell lines," J Natl Cancer Inst. Oct. 4, 2000;92(19):1573-81.
Mandler et al., "Modifications in synthesis strategy improve the yield and efficacy of geldanamycin-herceptin immunoconjugates," Bioconjug Chem. Jul.-Aug. 2002;13(4):786-91.
Mandler et al., "Synthesis and evaluation of antiproliferative activity of a geldanamycin-Herceptin immunoconjugate," Bioorg Med Chem Lett. May 15, 2000;10(10):1025-8.
Maute et al., "Engineering high-affinity PD-1 variants for optimized immunotherapy and immuno-PET imaging," Proc Natl Acad Sci U S A. (2015) 112(47): E6506-14.
Mayr et al., "Passage history, properties, and applicability of the attenuated vaccinia virus strain MVA," Infection. (1975);3:6-14. (English translation of abstract provided).
McLoughlin et al., "TNFerade, an adenovector carrying the transgene for human tumor necrosis factor alpha, for patients with advanced solid tumors: surgical experience and long-term follow-up," Ann Surg Oncol. (2005( Oct.;12(10):825-30.
McWilliams et al., "Mutations in the 5' end of the human immunodeficiency virus type 1 polypurine tract affect RNase H cleavage specificity and virus titer," J Virol. (2003) 77(20):11150-11157.
Merchant et al., "An efficient route to human bispecific IgG," Nat Biotechnol. (1998) 16(7): 677-681.
Mercier et al., "A chimeric adenovirus vector encoding reovirus attachment protein sigma1 targets cells expressing junctional adhesion molecule 1," Proc Natl Acad Sci U S A. (2004) 101(16): 6188-6193.
Miller et al., "Construction and properties of retrovirus packaging cells based on gibbon ape leukemia virus," J Virol. (1991) 65(5):2220-2224.
Miller et al., "Construction and screening of antigen targeted immune yeast surface display antibody libraries," Curr Protoc Cytom. Jul. 2008;Chapter 4:Unit4.7.
Miller et al., "Gene transfer by retrovirus vectors occurs only in cells that are actively replicating at the time of infection," Mol Cell Biol. (1990) 10(8):4239-4242.
Miller, "Protein-protein recognition and the association of immunoglobulin constant domains," J Mol Biol. Dec. 20, 1990;216(4):965-73.
Milone et al., "Chimeric receptors containing CD137 signal transduction domains mediate enhanced survival of T cells and increased antileukemic efficacy in vivo," Mol Ther. (2009) 17(8):1453-64.
Miyoshi et al. "Development of a self-inactivating lentivirus vector," J Virol. (1998) 72(10):8150-8157.
Molin et al., "Two novel adenovirus vector systems permitting regulated protein expression in gene transfer experiments," J Virol. (1998) 72(10):8358-8361.
Morton et al., "Differential effects of CTLA-4 substitutions on the binding of human CD80 (B7-1) and CD86 (B7-2)," J Immunol. (1996) 156(3):1047-1054.
Narumi et al., "Adenovirus vector-mediated perforin expression driven by a glucocorticoid-inducible promoter inhibits tumor growth in vivo," Am J Respir Cell Mol Biol. (1998) 19(6):936-941.
Nightingale et al., "Transient gene expression by nonintegrating lentiviral vectors," Mol Ther. (2006) 13(6):1121-1132.
Nygren, "Conjugation of horseradish peroxidase to Fab fragments with different homobifunctional and heterobifunctional cross-linking reagents. A comparative study," J Histochem Cytochem. May 1982;30(5):407-12.
Pain et al., "Preparation of protein A-peroxidase monoconjugate using a heterobifunctional reagent, and its use in enzyme immunoassays," J Immunol Methods. (1981);40(2):219-30.
Patyar et al., "Bacteria in cancer therapy: a novel experimental strategy," J Biomed Sci. (2010) 17(1):21.
Peach et al., "Both extracellular immunoglobin-like domains of CD80 contain residues critical for binding T cell surface receptors CTLA-4 and CD28," J Biol Chem. (1995) 270(36):21181-7.
Penix et al., "Two essential regulatory elements in the human interferon gamma promoter confer activation specific expression in T cells," J Exp Med. (1993) 178(5):1483-1496.
Peper et al., "An impedance-based cytotoxicity assay for real-time and label-free assessment of T-cell-mediated killing of adherent cells," J Immunol Methods. Mar. 2014;405:192-8.
Pérez De La Lastra et al., "Epitope mapping of 10 monoclonal antibodies against the pig analogue of human membrane cofactor protein (MCP)," Immunology. (1999) 96(4):663-70.
Petkova et al., "Enhanced half-life of genetically engineered human IgG1 antibodies in a humanized FcRn mouse model: potential application in humorally mediated autoimmune disease," Int Immunol. (2006) 18(12):1759-1769.
Pfeifer et al., "Gene therapy: promises and problems," Annu Rev Genomics Hum Genet. (2001);2:177-211.
Philpott et al., "Use of nonintegrating lentiviral vectors for gene therapy," Hum Gene Ther. (2007) 18(6): 483-9.
Powell et al., "Sequence and structural determinants required for priming of plus-strand DNA synthesis by the human immunodeficiency virus type 1 polypurine tract," J Virol. (1996) 70(8):5288-5296.
Ravetch et al., "Fc receptors," Annu Rev Immunol. (1991) 9:457-492.
Ridgway et al., "'Knobs-into-holes' engineering of antibody CH3 domains for heavy chain heterodimerization," Protein Eng. Jul. 1996;9(7):617-21.

(56) References Cited

OTHER PUBLICATIONS

Roach et al., "Development of a Companion Diagnostic PD-L1 Immunohistochemistry Assay for Pembrolizumab Therapy in Non-Small-cell Lung Cancer," Appl Immunohistochem Mol Morphol (2016) 24(6): 392-7.
Rosenberg et al., "Use of tumor-infiltrating lymphocytes and interleukin-2 in the immunotherapy of patients with metastatic melanoma. A preliminary report," N Engl J Med. (1988) 319(25):1676-1680.
Rowland et al., "Drug localisation and growth inhibition studies of vindesine-monoclonal anti-CEA conjugates in a human tumour xenograft," Cancer Immunol Immunother. (1986);21(3):183-7.
Sadelain, M. et al., "The basic principles of chimeric antigen receptor design." Cancer Discov., Apr. 2013, vol. 3, No. 4, pp. 388-398.
Seow et al., "Biological gene delivery vehicles: beyond viral vectors," Mol Ther. (2009) 17(5):767-777.
Shields et al., "High resolution mapping of the binding site on human IgG1 for Fc gamma RI, Fc gamma RII, Fc gamma RIII, and FcRn and design of IgG1 variants with improved binding to the Fc gamma R," J Biol Chem. (2001) 276(9):6591-6604.
Sommerfelt et al., "Receptor interference groups of 20 retroviruses plating on human cells," Virology. (1990) 176(1): 58-69.
Srivastava et al., "Engineering CAR-T cells: Design Concepts," Trends in Immunology (2015) 36(8):494-502.
Tangney et al., "The use of Listeria monocytogenes as a DNA delivery vector for cancer gene therapy," Bioeng Bugs. (2010) 1(4):284-287.
Tareen et al., "Design of a novel integration-deficient lentivector technology that incorporates genetic and posttranslational elements to target human dendritic cells," Mol Ther. (2014) 22(3):575-587.
Tartaglia et al., "Highly attenuated poxvirus vectors," AIDS Res Hum Retroviruses. (1992) 8(8):1445-1447.
Thompson et al., "cis-acting sequences required for inducible interleukin-2 enhancer function bind a novel Ets-related protein, Elf-1," Mol Cell Biol. (1992) 12(3):1043-1053.
Todd et al., "Transcription of the interleukin 4 gene is regulated by multiple promoter elements," J Exp Med. (1993) 177(6):1663-1674.
Topalian et al., "Safety, activity, and immune correlates of anti-PD-1 antibody in cancer," N engl J Med (2012) 366:2443-2454.
Uniprot H926YO ICOS ligand Retrieved from https://www.uniprot.org/uniprot/H9Z6Y0. Retrieve on Jul. 10, 2020.
Uniprot L8Y5K4 ICOS Ligand Retrieved from https://www.uniprot.org/uniprot/L8Y5K4. Retrieved on Jul. 10, 2020.
Van Pijkeren et al., "A novel Listeria monocytogenes-based DNA delivery system for cancer gene therapy," Hum Gene Ther. Apr. 2010;21(4):405-16.
Vitetta et al., "Redesigning nature's poisons to create anti-tumor reagents," Science. Nov. 20, 1987;238(4830):1098-104.
Wang et al., "In vitro characterization of the anti-PD-1 antibody nivolumab, BMS-936558, and in vivo toxicology in non-human primates," Cancer Immunol Res. (2014) 2(9):846-856.
Wang et al., "Molecular modeling and functional mapping of B7-H1 and B7-DC uncouple costimulatory function from PD-1 interaction," J Exp Med. 2003 197(9):1083-91.
Wilson et al., "Formation of infectious hybrid virions with gibbon ape leukemia virus and human T-cell leukemia virus retroviral envelope glycoproteins and the gag and pol proteins of Moloney murine leukemia virus," J Virol. (1989) 63(5):2374-2378.
Wu et al., "CTLA-4-B7 Interaction Is Sufficient to Costimulate T Cell Clonal Expansion," J. Exp. Med. (1997) 185(7):1327-1335.
Wu et al., "IL-24 modulates IFN-gamma expression in patients with tuberculosis," Immunol Lett. (2008) 117(1):57-62.
Zhang et al., "An NKp30-Based Chimeric Anitgen Receptor Promotes T Cell Effector Functions and Antitumor Efficacy In Vivo," J Immunol (2012) 189:2290-2299.
Zhao et al., "TIGIT overexpression diminishes the function of CD4 T cells and ameliorates the severity of rheumatoid arthritis in mouse models," Exp Cell Res. Jan. 1, 2016;340(1):132-8.
Zimin et al., "A new rhesus macaque assembly and annotation for next-generation sequencing analyses," Biol Direct. Oct. 14, 2014;9(1):20.
Zufferey et al., "Self-inactivating lentivirus vector for safe and efficient in vivo gene delivery," J Virol. (1998) 72(12):9873-9880.
Zhang et al., "Crystal structure of the receptor-binding domain of human B7-2: insights into organization and signaling," Proc Natl Acad Sci U S A. (2003) 100(5):2586-91.

\* cited by examiner

FIG. 5

```
SEQ ID NO: 37    1   PGWFLDSPDRPWNPPTFSPALLVVTEGDNATFTCSFSNTSESFVLNWYRM   50
                     ||||||||||||||||||||||||||||||||||||||||||||
SEQ ID NO: 392   1   ------DSPDRPWNPPTFSPALLVVTEGDNATFTCSFSNTSESFVLNWYRM   45

SEQ ID NO: 37    51  SPSNQTDKLAAFPEDRSQPGQDCRFRVTQLPNGRDFHMSVVRARRNDSGT  100
                     |||||||||||||||||||||||||||||||||||||||||||||||||
SEQ ID NO: 392   46  SPSNQTDKLAAFPEDRSQPGQDCRFRVTQLPNGRDFHMSVVRARRNDSGT   95

SEQ ID NO: 37    101 YLCGAISLAPKAQIKESLRAELRVTERRAEVPTAHPSPSPRPAGQFQTLV  150
                     ||||||||||||||||||||||||||||
SEQ ID NO: 392   96  YLCGAISLAPKAQIKESLRAELRVTER-----------------------  122
```

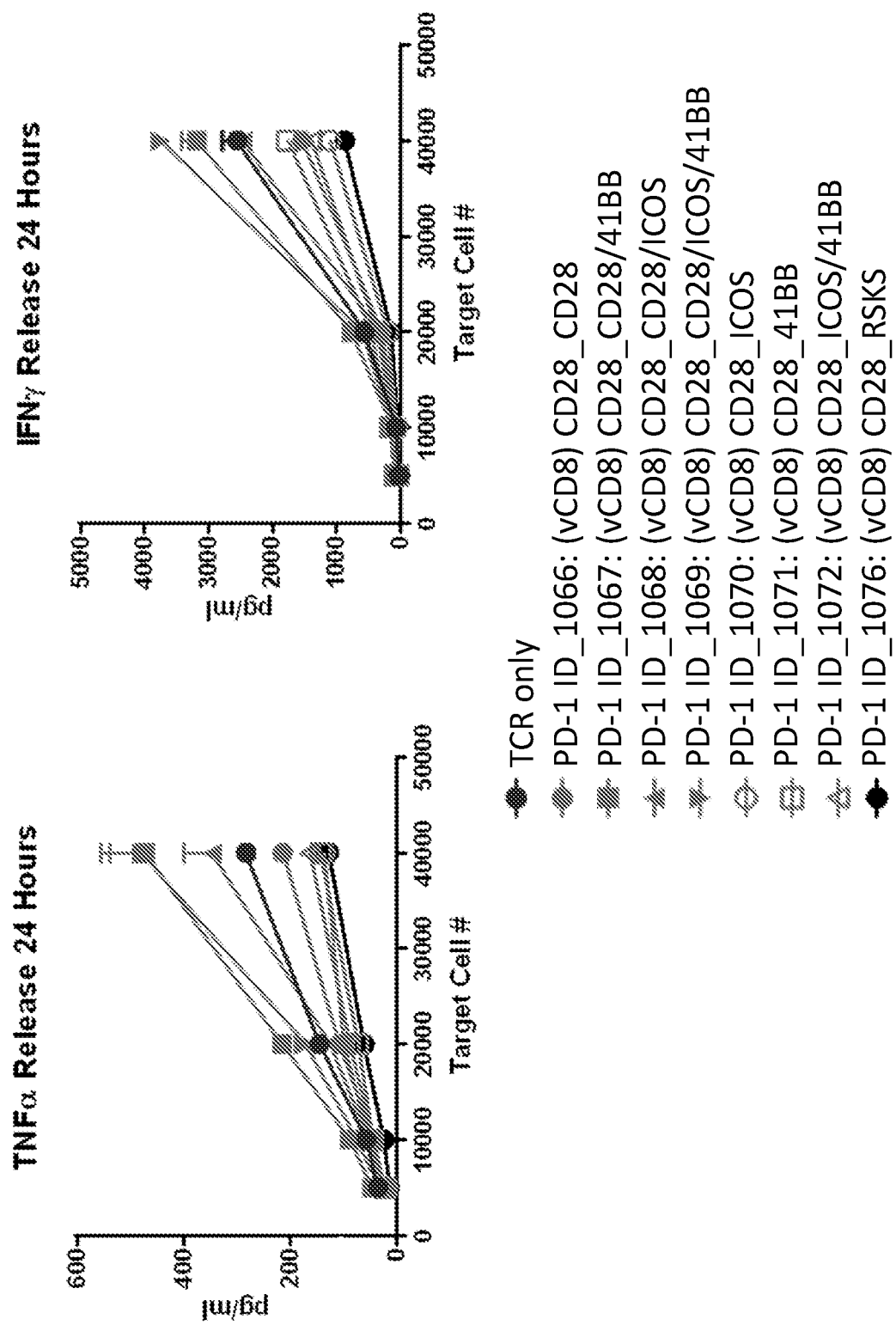

FIG. 8

```
SEQ ID NO: 29    APLKIQAYFNETADLPCQFANSQNQSLSELVVFWQDQENLVLNEVYLGKEKFDSVHSKYM    60
SEQ ID NO: 1104  ----------NETADLPCQFANSQNQSLSELVVFWQDQENLVLNEVYLGKEKFDSVHSKYM    51
                           ********************************************

SEQ ID NO: 29    GRTSFDSDSWTLRLHNLQIKDKGLYQCIIHHKKPTGMIRIHQMNSELSVLANFSQPEIVP   120
SEQ ID NO: 1104  GRTSFDSDSWTLRLHNLQIKDEGLYQCIIHHKKPTGMIRIHQMNSELS------------    99
                 ********************.**************************

SEQ ID NO: 29    ISNITENVYINLTCSSIHGYPEPKKMSVLLRTKNSTIEYDGVMQKSQDNVTELYDVSISL   180
SEQ ID NO: 1104  ------------------------------------------------------------    99

SEQ ID NO: 29    SVSFPDVTSNMTIFCILETDKTRLLSSPFSTELEDPQPPPDHIP   224
SEQ ID NO: 1104  -------------------------------------------    99
```

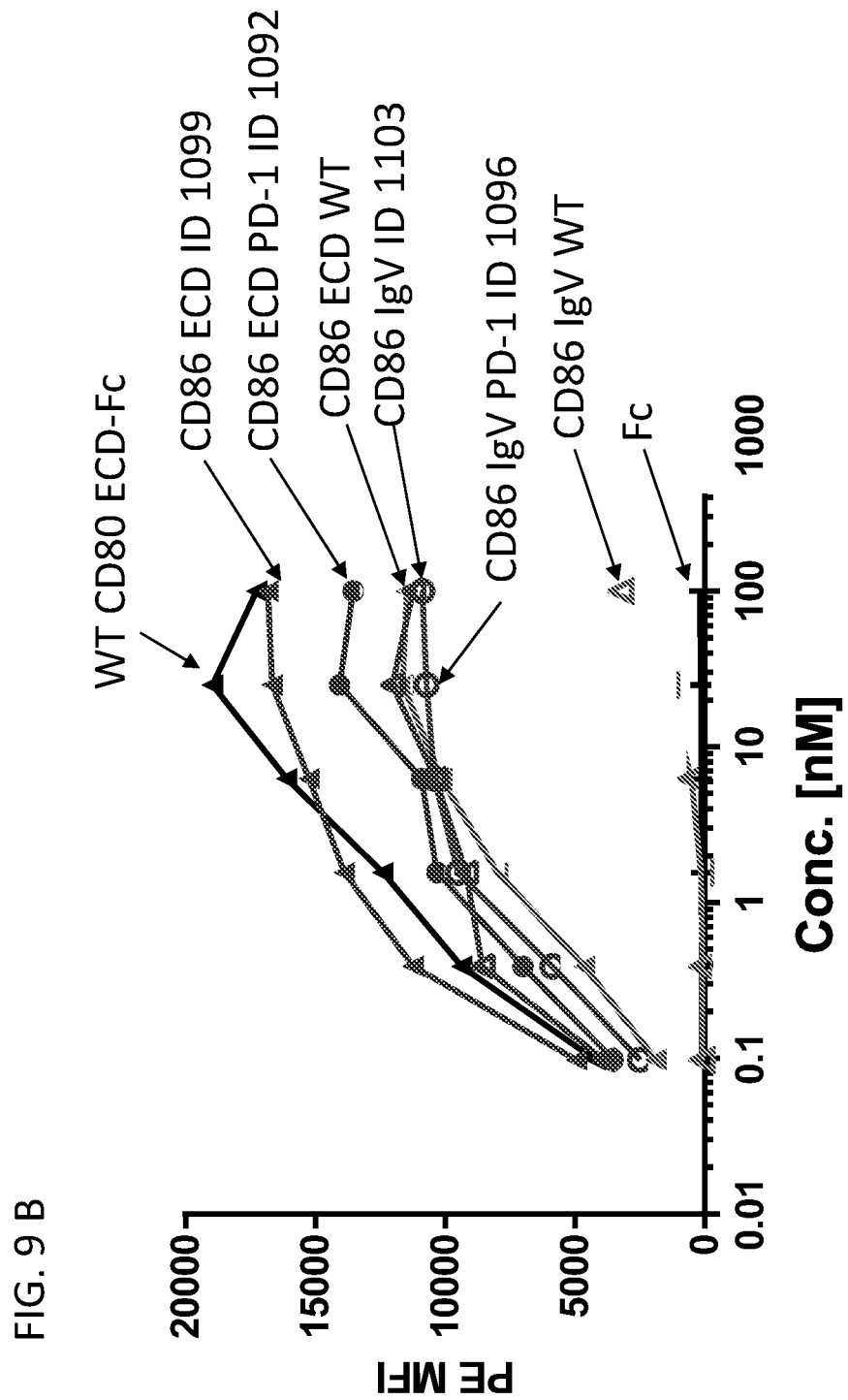

US 12,065,476 B2

PD-1 VARIANT IMMUNOMODULATORY PROTEINS AND USES THEREOF

CROSS-REFERENCE TO RELATED APPLICATIONS

This application is a National Stage application under 35 U.S.C. § 371 of International Application No. PCT/US2019/037388, filed on Jun. 14, 2019, which claims priority from U.S. provisional patent application 62/685,880, filed Jun. 15, 2018, entitled "PD-1 VARIANT IMMUNOMODULATORY PROTEINS AND USES THEREOF," U.S. provisional patent application 62/753,886, filed Oct. 31, 2018, entitled "PD-1 VARIANT IMMUNOMODULATORY PROTEINS AND USES THEREOF," and U.S. provisional patent application 62/774,145, filed Nov. 30, 2018, entitled the "PD-1 VARIANT IMMUNOMODULATORY PROTEINS AND USES THEREOF," contents of each of which are incorporated herein by reference in their entirety.

INCORPORATION BY REFERENCE OF SEQUENCE LISTING

The present application is being filed along with a Sequence Listing in electronic format. The Sequence Listing is provided as a file entitled 761612002400SeqList.TXT, created Dec. 14, 2020, which is 1,633,330 bytes in size. The information in the electronic format of the Sequence Listing is incorporated by reference in its entirety.

FIELD

The present disclosure relates to therapeutic compositions for modulating immune response in the treatment of cancer and immunological diseases. In some aspects, the present disclosure relates to particular variants of PD-1 that exhibit improved binding, such as improved binding affinity, for one or more of the cognate binding partner proteins, such as for PD-L1 (also known as B7-H1).

BACKGROUND

Modulation of the immune response by intervening in the processes that occur in the immunological synapse (IS) formed by and between antigen-presenting cells (APCs) or target cells and lymphocytes is of increasing medical interest. Mechanistically, cell surface proteins in the IS can involve the coordinated and often simultaneous interaction of multiple protein targets with a single protein to which they bind. IS interactions occur in close association with the junction of two cells, and a single protein in this structure can interact with both a protein on the same cell (cis) as well as a protein on the associated cell (trans), likely at the same time. Although therapeutics are known that can modulate the IS, improved therapeutics are needed. Provided are immunomodulatory proteins, including soluble proteins, that meet such needs.

SUMMARY

Provided herein are variant PD-1 polypeptides containing an IgV domain or a specific binding fragment thereof, wherein the variant PD-1 polypeptide includes one or more amino acid modifications in a position(s) of an unmodified PD-1 polypeptide or a specific binding fragment thereof corresponding to position(s) selected from 8, 9, 11, 12, 14, 16, 18, 20, 21, 22, 23, 24, 28, 31, 33, 34, 35, 36, 37, 40, 41, 42, 43, 51, 52, 59, 64, 66, 75, 80, 81, 85, 86, 89, 90, 91, 93, 94, 100, 106, 113, 114, 116, 129, 130, 132, 133, 134, 135, 136, 137, 138, 139, 140, 141, 142, 143 or 144 with reference to numbering of positions set forth in SEQ ID NO:37. In some embodiments, the one or more amino acid modifications are selected from an amino acid substitution P8T, D9E, D9G, D9N, D9V, P11A, W12G, W12L, W12R, P14H, P14L, P14S, T16A, T16I, T16S, S18T, A20S, A20T, A20V, L21V, L22I, V23E, V23G, V24L, D28E, T31I, T31N, T31S, T33I, C34Y, S35N, F36I, F36L, F36Y, S37P, S37T, S40P, S40T, E41D, E41V, S42G, S42R, F43L, F43Y, S51G, P52A, P52L, L59M, L59R, L59V, E64D, E64K, R66H, R66S, F75Y, L80Q, P81S, R84H, R84Q, D85G, D85N, F86Y, S89G, S89N, V90L, V90M, V91A, V91D, V91I, A93V, R94Q, T100A, T100I, T100S, I106L, Q113R, Q113W, I114T, E116D, A129S, E130K, P132H, P132R, P132S, P132T, T133A, T133R, T133S, A134D, A134V, H135N, H135R, H135Y, P136L, P136T, S137C, P138S, P138T, S139T, P140A, P140L, P140R, R141G, R141M, R141S, R141W, P142A, P142L, P142R, P142T, A143D, A143S, A143V, G144D, or G144S, or a conservative amino acid substitution thereof. In some embodiments, at least one amino acid modification is at a position selected from 12, 40, 59, 86, 93, 133, 141 or 143.

Also provided are variant PD-1 polypeptides containing an IgV domain or a specific binding fragment thereof, wherein the variant PD-1 polypeptide includes one or more amino acid modifications in an unmodified PD-1 polypeptide or a specific binding fragment thereof corresponding to amino acid modification(s) selected from an amino acid substitution P8T, D9E, D9G, D9N, D9V, P11A, W12G, W12L, W12R, N13Y, P14H, P14L, P14S, T16A, T16I, T16S, F17I, F17V, F17Y, S18T, A20S, A20T, A20V, L21V, L22I, V23E, V23G, V24L, D28E, N29D, T31I, T31N, T31S, T33I, C34Y, S35N, F36I, F36L, F36Y, S37P, S37T, N38S, N38T, T39R, T39S, S40P, S40T, E41D, E41V, S42G, S42R, F43L, F43Y, V44M, Y48N, M50T, S51G, P52A, P52L, S53T, N54H, Q55R, T56M, T56P, T56S, K58R, L59M, L59R, L59V, E64D, E64K, R66H, R66S, S67C, S67I, S67N, S67R, P69H, G70C, G70E, G70S, Q71H, Q71K, Q71L, D72N, C73A, C73G, C73H, C73P, C73Y, F75Y, R76H, R76S, V77D, T78S, Q79P, L80Q, P81S, R84H, R84Q, D85G, D85N, F86Y, H87L, S89G, S89N, V90L, V90M, V91A, V91D, V91I, R92N, R92S, A93V, R94Q, R95L, N96T, T100A, T100I, T100S, L102F, G104A, G104T, G104V, A105C, A105G, A105L, I106L, L108T, A109G, K111M, K111N, Q113R, Q113W, I114T, K115D, K115E, K115IN, K115N, K115Q, E116D, R119H, R119L, R119P, R119Q, R119W, T125K, T125S, R127S, R128M, A129S, E130K, V131A, V131E, P132H, P132R, P132S, P132T, T133A, T133R, T133S, A134D, A134V, H135N, H135R, H135Y, P136L, P136T, S137C, P138S, P138T, S139T, P140A, P140L, P140R, R141G, R141M, R141S, R141W, P142A, P142L, P142R, P142T, A143D, A143S, A143V, G144D, or G144S, or a conservative amino acid substitution thereof with reference to numbering of positions set forth in SEQ ID NO:37.

In some of any such embodiments, at least one amino acid modification is W12G, W12L or W12R. In some examples, at least one amino acid modification is S40P or S40T. In some embodiments, at least one amino acid modification is L59R or L59V. In some embodiments, at least one amino acid modification is F86Y. In some embodiments, at least one amino acid modification is A93V. In some embodiments, at least one amino acid modification is T133A, T133R or T133S. In some embodiments, at least one amino acid modification is A143D, A143S or A143V. In some embodiments, at least one amino acid modification is F17I, F17V or F17Y. In some embodiments, at least one amino acid modification is T56M, T56P or T56S. In some embodiments, at least one amino acid modification is S67C, S67I, S67N or S67R. In some embodiments, the variant PD-1 polypeptide contains the amino acid modifications S67N and F86Y. In some embodiments, at least one amino acid modification is R95L. In some embodiments, at least one amino acid modification is G104A or G104V. In some embodiments, at least one amino acid modification is K111M or K111N. In some embodiments, at least one amino acid modification is K115D, K115E, K115IN, K115N or K115Q. In some embodiments, at least one amino acid modification is R119H, R119L, R119P, R119Q or R119W.

In some of any such embodiments, the variant PD-1 polypeptide contains one or more further amino acid modifications in a position(s) corresponding to position(s) 73, 86, 107, 112, 115, 119 or 120, with reference to numbering of positions set forth in SEQ ID NO:37. In some embodiments, the one or more further amino acid modifications is selected from C73A, C73G, C73H, C73P, C73R, C73S, C73Y, F86Y, S107T, A112I, A112V, K115D, K115E, K115I, K115N, K115Q, R119H, R119L, R119P, R119Q, R119W or A120V. In some embodiments, the variant PD-1 polypeptide contains one or more further amino acid modifications selected from N13D, N13S, N13Y, F17I, F17L, F17V, F17Y, T25A, N29D, A30V, N38D, N38S, N38T, T39R, T39S, V44H, V44M, L45V, N46I, Y48F, Y48H, Y48N, L45E, L45I, L45L, L45T, L45V, N46I, Y48F, Y48H, M50E, M50I, M50L, M50V, S53G, S53N, S53T, N54D, N54G, N54H, N54S, N54Y, Q55R, T56A, T56M, T56P, T56S, T56V, D57V, D57Y, K58R, K58T, S67C, S67G, S67I, S67N, S67R, Q68P, Q68R, P69H, P69L, P69S, G70C, G70E, G70R, G70S, G70V, Q71H, Q71K, Q71L, Q71R, D72G, D72N, C73A, C73G, C73H, C73P, C73R, C73S, C73Y, R76H, R76S, V77D, T78S, Q79P, Q79R, H87L, H87R, R92G, R92N, R92S, R95L, N96D, N96S, N96T, L102F, L102V, G104A, G104T, G104S, G104V, A105C, A105G, A105L, A105V, S107T, L108F, L108T, A109G, K111E, K111M, K111N, K111R, K111T, A112I, A112V, K115D, K115E, K115I, K115N, K115Q, R119H, R119L, R119P, R119Q, R119W, A120V, T125I, T125K, T125S, R127S, R128M, V131A, or V131E, or a conservative amino acid substitution thereof. In some embodiments, the PD-1 polypeptide of any of contains one or more further amino acid modifications selected from N13D, N13S, F17L, T25A, A30V, N38D, V44H, L45V, N46I, Y48F, Y48H, M50E, M50I, M50L, M50V, S53G, S53N, N54D, N54G, N54S, N54Y, T56A, T56V, D57V, D57Y, K58T, S67G, Q68P, Q68R, P69L, P69S, G70R, G70V, Q71R, D72G, C73S, C73R, Q79P, H87R, R92G, N96D, N96S, L102V, G104S, A105V, S107T, L108F, K111E, K111R, K111T, A120V or T125I.

In some embodiments, the one or more further amino acid modification includes at least one further amino acid modification that is M50E, M50I, M50L or M50V. In some embodiments, the one or more further amino acid modification includes at least one further amino acid modification that is P69L or P69S. In some embodiments, the one or more further amino acid modification includes at least one further amino acid modification that is C73R or C73S. In some embodiments, the amino acid modifications S67N/C73R, S67N/C73S, C73R/F86Y, C73S/F86Y, C73R/R119L, C73S/R119L, C73R/R119W or C73S/R119W.

In some embodiments, the one or more further amino acid modification includes at least one further amino acid modification that is R92G. In some embodiments, the one or more further amino acid modification includes at least one further amino acid modification that is S107T. In some embodiments, the one or more further amino acid modification includes at least one further amino acid modification that is A112I or A112V. In some cases, the amino acid modifications include S67N/A112I, S67N/A112V, F86Y/A112I, F86Y/A112V, A112I/R119L, A112V/R119L, A112I/R119W or A112V/R119W. In some embodiments, the one or more further amino acid modification includes at least one further amino acid modification that is A120V. In some examples, the amino acid modifications include S67N/A120V, F86Y/A120V, R119L/A120V or R119W/A120V. In some embodiments, the one or more further amino acid modification includes at least one further amino acid modification that is T125I.

In some of any such embodiments, the variant PD-1 polypeptide contains up to 1, 2, 3, 4, 5, 6, 7, 8, 9, 10, 11, 12, 13, 14, 15, 16, 17, 18, 19 or 20 amino acid modification, optionally wherein the amino acid modification is an amino acid substitution.

Provided herein are variant PD-1 polypeptides containing an IgV domain or a specific binding fragment thereof, wherein the variant PD-1 polypeptide contains two or more amino acid modification in an unmodified PD-1 polypeptide or a specific binding fragment thereof corresponding to amino acid modification(s) selected from C73A, C73G, C73H, C73P, C73R, C73S, C73Y, F86Y, S107T, A112V, K115D, K115E, K115I, K115N, K115Q, R119H, R119L, R119P, R119Q, R119W or A120V, with reference to numbering of positions set forth in SEQ ID NO:37. In some examples, the two or more amino acid modifications in an unmodified PD-1 polypeptide or a specific binding fragment thereof corresponds to amino acid modification(s) C73A/F86Y, C73G/F86Y, C73H/F86Y, C73P/F86Y, C73R/F86Y, C73S/F86Y, C73Y/F86Y, F86Y/K115D, F86Y/K115E, F86Y/K115I, F86Y/K115N, F86Y/K115Q, F86Y/R119H, F86Y/R119L, F86Y/R119P, F86Y/R119Q, F86Y/R119W, C73A/S107T, C73G/S107T, C73H/S107T, C73P/S107T, C73R/S107T, C73S/S107T, C73Y/S107T, S107T/K115D, S107T/K115E, S107T/K115I, S107T/K115N, S107T/K115Q, S107T/R119H, S107T/R119L, S107T/R119P, S107T/R119Q, S107T/R119W, C73A/A112V, C73G/A112V, C73H/A112V, C73P/A112V, C73R/A112V, C73S/A112V, C73Y/A112V, A112V/K115D, A112V/K115E, A112V/K115I, A112V/K115N, A112V/K115Q, A112V/R119H, A112V/R119L, A112V/R119P, A112V/R119Q, A112V/R119W, C73A/A120V, C73G/A120V, C73H/A120V, C73P/A120V, C73R/A120V, C73S/A120V, C73Y/A120V, K115D/A120V, K115E/A120V, K115I/A120V, K115N/A120V, K115Q/A120V, R119H/A120V, R119L/A120V, R119P/A120V, R119Q/A120V, R119W/A120V, F86Y/S107T, F86Y/A112V, F86Y/A120V, S107T/A112V, S107T/A120V or A112V/A120V.

In some embodiments, the variant PD-1 polypeptide contains 2, 3, 4, 5, 6, 7, 8, 9, 10, 11, 12, 13, 14, 15, 16, 17, 18, 19 or 20 amino acid modifications, optionally wherein the amino acid modifications are amino acid substitutions. In some cases, the variant PD-1 polypeptide includes replacement of a cysteine residue at a position corresponding to position 73 to another amino acid, wherein the replacement is to an amino acid residue selected from Ala (A), Arg (R) or Ser (S); and/or replacement of the amino acid residue at a position corresponding to position 59 or 60 with a cysteine, wherein numbering is with reference to positions set forth in SEQ ID NO:37.

In some embodiments, the variant PD-1 polypeptide includes one or more amino acid modifications in an unmodified PD-1 polypeptide or a specific binding fragment thereof corresponding to amino acid modification(s) selected from A112V/R119L/A120V; N13S/A120V/P142A; C34Y/N54D/T100S/A112V/A120V; M50V/S67V/L80Q/A120V/A143S; A112V/R119W; R84H/H87L/A112V/R119W; Q71R/V91I/A112V/R119L/A120V/T125S; A112V/K115E; M50L/L59V/R66H/A112V/H135Y/P138T/P142L; R119W; S53G/Q55R/A112V/K115E/A120V/S139T; R119W/H135R; A120V/T125I; A112V/A120V/V131A; F17I/K111E/A112V/A120V; S18T/R119Q/R141M; F36L/S37T/A112V/H135N/P138S; A112V/T125I; M50I/A112V/A120V; S67N/C73R/A93V/A112V/A120V; D72G/A112V/A120V; N96D/A112V/A120V/T125S; F86Y/R119W/T125I; R119P/T133R; K111M/A112V/K115E/P132H; S67G/A112V/T125I/T133S; A112V/A120V; S37P/A112V/R119W; W12L/S37P/A112V/R119W; D9G/A112V/A120V; T31S/S37T/A112V/T125I/A143S; S37T/A112V/T125I; R92G/A112V/A120V; E64D/F86Y/A112V/A120V; H87R/A112V/R119W; N13D/A105V/A112V/A120V/A134D; A112V/R119L/A120V/S137C; T16I/M50I/A112V/A120V; M50L/A112V/R119Q/A120V/T125I/H135R; D57V/A112V; S67N/R119W; S67N/A112V/A120V; N54Y/A112V/P140A; F43Y/P69L/R119W; N54Y/A112V/R119W; T56M/C73S/R76H/A112V/R119L/A120V/P132T/R141W; F17I/S40P/E41D/S67N/R95L/A112V/A120V/T125I/R141M; F17L/T31S/S35N/P81S/N96S/A112V/R119W; F43L/S67N/C73R/A112V/A120V; W12L/N38D/A112V/R119Q/A120V/P142T; S67N/P69H/C73R/Q79P/V91D/A112V/A120V/P136T/A143D; F17I/S40P/S67N/Q79R/A112V/R119W/T125I; F43Y/M50V/S67N/C73R/R92G/A112V/A120V/P136T; F17L/T56M/S67N/A112V/R119W/A120V/P142R; W12L/N54Y/S67N/F75Y/V91D/R95L/G104A/A112V/R119W/R141M; F17L/S37T/S67N/T78S/F86Y/A112V/R119H/A120V/V131E/A143V; N13D/S40P/A112V/R119L/A120V/S137C; F17V/A30V/E41V/R76S/A112V/R119Q/A120V/V131A; F17I/T25A/M50V/S53T/R66S/S67R/S107T/A112V/R119W/A143V; N13D/S40P/S67N/C73R/R95L/G104A/A112V/A120V; S40P/T56A/S67N/C73R/A112V/R119Q/A120V/V131A; N13Y/S40P/F43L/Q68P/R92G/A112V/R119L/A120V; F17L/S67N/Q71L/C73S/A112V/R119Q/A120V/P142L; F17I/S40P/P69S/C73S/N96S/G104A/A112V/A120V; F17I/S40P/A112V/R119L/A120V/P140R; A112V/A120V/T133S; A20S/S67N/C73R/R94Q/A112V/R119Q/A120V/T125I/P132S; N13D/S67N/C73R/R95L/A112V/R119Q/A120V/T125I; S40P/S67N/C73R/N96T/A112V/A120V; L21V/S40P/R95L/G104A/A112V/A120V/A129S/V131A/R141G; P14S/S40P/S42R/P52A/T56M/A112V/R119W/T125I/P142A; S40P/F43L/T56A/S67N/C73S/A112V/R119L/A120V; F17I/S40P/M50V/S67N/C73S/R95L/G104A/A112V/R119L/A120V; S40P/T56M/C73S/R95L/A112V/R119W/T125I/V131A/R141W; F17I/A20V/S51G/N54D/F86Y/A112V/A120V/T125I; F17I/T31N/T56M/S67N/C73R/G104A/A112V/R119Q/A120V/T133A/P140L; F17V/S40P/R92G/R95L/A112V/R119W; W12G/F17L/T56V/S67N/A112V/R119W/V131E/R141S; F86Y/R92G/A112V/R119L/A120V/T125K/T133S; P8T/F17I/S67N/F86Y/G104A/A112V/A120V/S139T; F17I/S40P/A112V/R119W/G144D L22I/S67I/G70S/Q71R/S107T/A112V/R119L/A120V/T125I/T133S; S40P/A112V/A120V; T16S/S67N/C73R/A112V/R119W; N13D/S40P/A112V/A120V/T125I/T133S; M50L/V91D/A112V/R119W/P132R/R141G; F17I/S40P/M50I/S67R/A112V/R119L/A120V/S137C; S40P/A112V/R119W; F17I/V24L/A112V/R119W; S40P/S67N/C73R/A93V/A112V/A120V; N13D/F17I/A112V/R119W/R141M; S67N/C73R/A112V/A120V/R141S; W12R/L59V/R66H/F86Y/V90L/A112V/K115N/R119L/A120V; F36L/M50I/S51G/C73R/S107T/K111M/A120V/V131E; M50V/R119W/A120V/T125I/R141G; A109G/A112V/K115E/R119W; Q55R/R76H/A112V/K115I/A120V; W12R/F86Y/R95L/A112V/R119P/T133R; S67N/C73Y/A112V; F17I/S40P/T56S/A112V; W12L/P14S/M50V/S67R/A93V/R94Q/K111T/A112V/R119W/A120V; F36L/L59R/S67N/A105L/A112V/R119W/A120V/A143V; L59M/E64K/F86Y/R94Q/A112V/R119L/A120V/T125I/T133S; P14H/F17Y/T39R/S40T/K58R/V77D/G104V/A112V/Q113R/I114T/A143V; D57V/L59M/P69S/C73S/A112V/R119L/A120V/A134V; V23E/T39S/S40P/C73Y/V91A/R92N/L102F/A112V/R119W/A120V; T16A/F17I/F36L/S67N/C73R/H87L/R92G/R95L/A112V/R119W; C73S/A105V/A112V/R119W/A120V/T133A; P14S/M50L/L59V/R66H/G70S/C73R/A112V/A120V/T125I/G144S; P8T/S40P/S53N/R95L/A112V/A120V/T125I/R128M/P138T/R141G; S37T/T56M/C73S/D85N/A109G/A112V/A120V/H135Y/A143S; S67N/C73R/A93V/G104A/A112V/R119Q/R127S/H135R; S40P/S67N/C73R/A112V/A120V; S67N/C73R/A93V/A112V/R119W; C73R/A93V/A112V/R119W; S67N/C73R/A112V/A120V; N13D/P69H/C73R/A93V/A112V/R119W/R141S; F17I/N38D/S40P/S67N/C73R/A112V/A120V; N13D/F17I/S40P/T56M/R66S/S67N/G70C/A112V/A120V/R141S; S40P/F43L/R66S/S67N/G70C/A112V/R119L/A120V; V23G/S40T/G104A/A112V/R119L/A120V; W12R/F36I/N54Y/S67I/C73S/A93V/G104A/A112V/K115Q/R119W; S40P/M50L/S67I/C73S/R92G/A93V/A112V/A120V/R141S; F17I/T25A/S40P/F43Y/S67N/C73R/F86Y/A112V/R119W/T125I; F17I/S40P/M50L/S67I/C73S/A112V/A120V/E130K/P136L; W12R/S40P/S67N/C73R/A93V/A112V/A120V/R141S; F17I/S40P/M50L/S67I/C73S/R92G/A93V/A112V/A120V/R141S; F17I/S40P/M50L/S67I/A112V/A120V/R141S; V23 G/T56P/S67I/C73S/F86Y/R92G/G104A/A112V/R119W/A143D; F17I/S40P/M50L/S67I/C73S/R92G/A93V/A112V/R119W/T125I; D9V/P11A/N13D/S40T/T56M/S67N/R95L/G104A/A112V/R119L/A120V; F17I/T25A/S40P/F43Y/S67N/A112V/R119L/A120V; D9E/F17I/S40P/M50L/S67I/C73S/V90M/T100A/G104A/K111M/A112V/R119W/A120V/A143D; F17I/S40P/M50L/S67I/C73S/R92G/A93V/A112V/A120V/R141G; F17I/S40P/S67N/S89G/R95L/A112V/R119W/T125I; F17I/S40P/M50L/S67I/C73S/R92G/A93V/K111M/A112V/R119Q/A120V; D9N/F17I/T31N/S40P/M50L/S67I/C73S/R92G/A93V/A112V/A120V/R141S; N13D/S40T/T56M/S67N/R95L/G104A/K111R/A112V/A120V/T125I; W12G/F17I/S40P/M50L/A112V/P132T; D9N/F17I/S40P/M50T/T56A/G70S/C73R/R92G/A93V/A112V/A120V/R141S; N38S/L59M/Q71L/S107T/A112V/K115E/R119Q/A120V; M50V/L59M/A112V/R119Q/A120V P81S/F86Y/R92S/S107T/A112V/K115E/A120V; C73R/R84Q/F86Y/S107T/A112V/K115D/A120V; W12G/M50T/S53N/S67R/G70S/C73R/G104V/A112V/K115E/R119W; T31I/F36Y/F43Y/S67N/G70S/C73R/V90M/A112V/R119W; R76S/S107T/K111N/A112V/K115N/A120V; F86Y/A112V/R119W/A120V; N13S/M50I/R76S/S107T/A112V/K115N/R119W/A120V; P14H/T16S/M50L/C73R/R84Q/F86Y/S107T/A112V/K115E/A120V; F17L/T25A/L59M/E64K/F86Y/R94Q/S107T/A112V/K115N/R119W/A120V; Q71R/F86Y/A112V/K115E/R119Q/A120V; R76S/S107T/A112V/K115N/R119W/A120V; M50I/A112V/K115D/A120V; M50V/P81S/F86Y/R92S/S107T/A112V/K115E/A120V; M50I/S67N/G70R/K111T/A112V/R119W/A120V; P14H/T16S/M50L/L80Q/K111M/R119Q/A120V; T31I/F36Y/E64K/A112V/K115E/R119Q/A120V; S107T/A112V/R119W/A120V; T56S/A112V/K115E/A120V; T56S/

A112V/R119W; N46I/Y48N/D57Y/S67C/V90L/A112V; T56S/A112V/R119P; P14H/F17I/V44M/A112V/K115E/A120V; N38S/T56S/A112V/K115E/A120V; S42G/M50L/P69S/F86Y/A112V/K115E; P14H/T56S/A112V/K115E/A120V; N13S/S67N/G70C/F86Y/S89N/V91D/A112V/R119L/A120V; W12G/S67N/Q71R/F86Y/K111M/A112V/K115Q/R119W; S67N/C73R/V91D/S107T/K111M/A112V/K115Q/R119W; N13S/M50I/R76S/S107T/K111M/A112V/K115Q/R119W; T33I/S67N/G70S/S107T/K111N/A112V/K115E/R119W; P69L/F86Y/V90M/T100I/S107T/K111N/A112V/K115N/A120V; F17L/T25A/P69L/F86Y/V90M/T100I/S107T/K111N/A112V/K115N/A120V; T33I/M50I/R76S/F86Y/S107T/A112V/K115N/R119W/A120V; N13S/S67N/C73R/F86Y/S107T/A112V/Q113R/K115E/A120V; S67N/C73R/F86Y/V91D/S107T/A112V/K115D/A120V; F17L/T25A/S67N/C73R/R84Q/F86Y/A93V/A112V/K115E/R119W; T56S/A112V/K115E P69L/V91D/A112V/K115N/R119W/A120V; N13S/E41D/M50I/G70V/D72N/F86Y/R94Q/A112V/R119L/A120V; M50I/P69L/F86Y/V90M/T100I/S107T/K111N/A112V/K115N/A120V; M50I/C73R/S107T/K111N/A112V/K115N/A120V; F86Y/A112V/K115N/R119W; M50I/S67N/C73R/F86Y/R95L/S107T/A112V/K115N/R119W; M50L/Q68R/P69S/F86Y/S107T/A112V/K115N/R119W; N38T/A112V/K115N/R119L/A120V; S67N/Q71H/F86Y/R95L/S107T/A112V/K115N/R119W; A20T/D28E/F36L/M50I/Q68R/P69S/F86Y/A112V/R119L/A120V; M50I/S67N/C73R/F86Y/R95L/A112V/Q113W/R119L/A120V; L59M/S67N/Q71L/C73R/R95L/S107T/A112V/K115N/R119W; P52L/S53N/C73S/A112V/E116D/R119W; Q71R/C73R/A112V/K115N/R119L/A120V; W12L/A20T/N29D/S37P/L59M/Q68R/P69S/F86Y/A112V/R119L/A120V; N46I/Y48F/D57V/P69L/A112V/K115N/R119W; M50I/S67N/C73R/F86Y/R95L/S107T/A112V/K115Q/R119Q/A120V; N54D/P69H/C73R/F86Y/R95L/S107T/A112V/K115N/R119W; T56S/Q71K/F86Y/R95L/S107T/A112V/K115N/R119W; C73A/F86Y/S107T/A112V/K115N/R119Q/A120V; C73R/F86Y/A105G/S107T/A112V/K115N/R119L/A120V; N54H/G70E/C73P/F86Y/A112V/K115D/R119L/A120V; C73G/F86Y/S107T/A112V/K115N/R119Q/A120V; N54S/C73G/F86Y/S107T/A112V/K115D/R119L/A120V; F86Y/S107T/A112V/K115D/R119W/A120V; G70E/C73P/F86Y/S107T/A112V/K115E/R119Q/A120V; C73G/F86Y/A105G/S107T/A112V/K115D/R119W; C73G/F86Y/S107T/A112V/K115D/R119L/A120V; C73S/F86Y/S107T/A112V/K115D/R119L/A120V; L45V/C73G/F86Y/G104A/S107T/A112V/K115N/R119W/A120V; C73P/F86Y/S107T/A112V/K115D/R119Q/A120V; C73S/F86Y/S107T/A112V/K115E/R119Q/A120V; C73S/F86Y/G104T/S107T/A112V/K115E/R119W/A120V; C73R/F86Y/S107T/K111R/A112V/K115D/A120V; P14L/C73G/F86Y/S107T/A112V/K115D/R119L/A120V; G70E/F86Y/S107T/A112V/K115D/R119L/A120V; C73G/F86Y/G104V/S107T/A112V/K115N/R119L/A120V; C73S/F86Y/G104S/S107T/L108F/A112V/K115D/R119L/A120V; C73S/F86Y/S107T/A112V/K115D/A120V; C73R/F86Y/S107T/A112V/K115D/R119L/A120V; C73S/F86Y/S107T/A112V/Q113R/K115D/R119L/A120V; C73S/F86Y/V91A/S107T/A112V/K115D/R119L/A120V; G70E/C73P/F86Y/A105G/S107T/A112V/K115D/R119Q/A120V; C73G/F86Y/A105G/S107T/A112V/K115D/R119L/A120V; C73G/F86Y/A105G/S107T/A112V/Q113R/K115D/R119L/A120V; F86Y/S107T/A112V/K115D/R119Q/A120V; C73R/F86Y/S107T/A112V/K115N/R119L/A120V; C73A/F86Y/S107T/A112V/Q113R/K115E/R119Q/A120V; C73R/F86Y/S107T/A112V/K115D/R119Q/A120V; C73G/F86Y/A112V/K115D/R119W/A120V; C73P/F86Y/A105G/S107T/A112V/Q113R/K115D/R119L/A120V; C73R/F86Y/A105G/S107T/A112V/K115D/R119L/A120V; C73A/F86Y/S107T/A112V/K115D/R119L/A120V; P69S/C73R/F86Y/S107T/A112V/K115D/R119W/A120V; C73S/F86Y/G104S/S107T/A112V/K115E/R119W/A120V; Q68R/C73S/F86Y/S107T/A112V/K115D/R119Q/A120V; C73R/F86Y/S107T/A112V/K115N/R119Q/A120V; G70E/C73R/F86Y/S107T/A112V/K115N/R119Q/A120V; C73S/F86Y/S107T/A112V/K115D/R119W/A120V; G70E/F86Y/G104T/I106L/S107T/L108T/A112V/K115N/R119L/A120V; C73H/F86Y/A105G/S107T/A112V/K115D/R119L/A120V; G70E/C73P/F86Y/A105C/S107T/A112V/K115D/R119L/A120V; G70E/C73P/F86Y/S107T/A112V/K115D/R119Q/A120V; C73S/F86Y/S107T/K111R/A112V/K115E/R119L/A120V; C73R/D85G/F86Y/A105G/S107T/A112V/K115D/R119Q/A120V; C73R/F86Y/S107T/A112V/K115E/R119W/A120V; N54S/C73G/F86Y/S107T/A112V/K115E/R119Q/A120V; C73S/F86Y/G104S/S107T/A112V/K115N/R119L/A120V; F17L/Q71R/C73G/F86Y/A105G/S107T/A112V/K115D/R119L/A120V; C73G/F86Y/S107T/A112V/K115E/R119W/A120V; G70E/C73G/F86Y/A105C/S107T/A112V/K115E/R119L/A120V; C73G/F86Y/G104A/S107T/A112V/K115D/R119W/A120V; C73S/F86Y/S107T/A112V/K115N/A120V; C73P/F86Y/S107T/A112V/K115N/R119L/A120V; W12R/F86Y/S107T/A112V/K115D/R119Q/A120V; G70E/C73G/F86Y/A105L/A112V/K115N/R119Q/A120V; F86Y/S107T/A112V/K115N/R119W/A120V, with reference to numbering of positions set forth in SEQ ID NO:37.

In some embodiments, the variant PD-1 polypeptide includes the amino acid modifications S67N/C73R/F86Y/V91D/S107T/A112V/K115D/A120V. In some cases, the variant PD-1 polypeptide includes the amino acid modifications P52L/S53N/C73S/A112V/E116D/R119W. In some embodiments, the variant PD-1 polypeptide includes the amino acid modifications Q71R/C73R/A112V/K115N/R119L/A120V.

In some of any such embodiments, the variant PD-1 polypeptide is or contains the IgV domain or a specific binding fragment thereof. In some embodiments, the unmodified PD-1 includes (i) the sequence of amino acids set forth in SEQ ID NO:37, (ii) a sequence of amino acids that has at least 95% sequence identity to SEQ ID NO:37; or (iii) is a portion of (i) or (ii) containing an IgV domain or specific binding fragment thereof. In some embodiments, the variant PD-1 polypeptide includes the sequence of amino acids set forth in any of SEQ ID NOS: 103-243, 490-548, or 869-926 or a specific binding fragment thereof, or a sequence of amino acids that exhibits at least 95% sequence identity to any of SEQ ID NOS: 103-243, 490-548, or 869-926 or a specific binding fragment thereof and that contains the one or more of the amino acid modifications thereof. In some embodiments, the unmodified PD-1 includes (i) the sequence of amino acids set forth in SEQ ID NO:392, (ii) a sequence of amino acids that has at least 95% sequence identity to SEQ ID NO:392; or (iii) is a portion of (i) or (ii) containing an IgV domain or specific binding fragment thereof.

In some embodiments, the variant PD-1 polypeptide includes the sequence of amino acids set forth in any of SEQ ID NOS: 393-451, 647-780 or 811-868 or a specific binding fragment thereof, or a sequence of amino acids that exhibits at least 95% sequence identity to any of SEQ ID NOS: 393-451, 647-780 or 811-868 or a specific binding fragment thereof and that contains the one or more of the amino acid modifications thereof. In some embodiments, the unmodified PD-1 includes (i) the sequence of amino acids set forth in SEQ ID NO:244, (ii) a sequence of amino acids that has at least 95% sequence identity to SEQ ID NO:244; or (iii) is a portion of (i) or (ii) containing an IgV domain or specific binding fragment thereof.

In some embodiments, the variant PD-1 polypeptide includes the sequence of amino acids set forth in any of SEQ ID NOS: 245-328, 549-606, 927-982 or a specific binding fragment thereof, or a sequence of amino acids that exhibits at least 95% sequence identity to any of SEQ ID NOS: 245-328, 549-606, 927-982 or a specific binding fragment thereof and that contains the one or more of the amino acid modifications thereof. In some embodiments, the extracellular domain or a portion thereof containing the IgV domain or specific binding fragment thereof is the only PD-1 portion of the variant PD-1 polypeptide.

In some of any such embodiments, the variant PD-1 exhibits increased binding to the ectodomain of human PD-L1 compared to the binding affinity of the unmodified PD-1 for the ectodomain of human PD-L1. In some examples, the binding affinity is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 60-fold, 80-fold, 100-fold, 150-fold, 200-fold, 250-fold, 300-fold, 400-fold, or 450-fold compared to binding affinity of the unmodified PD-1 for the ectodomain of PD-L1. In some cases, the PD-L1 is human PD-L1.

In some embodiments, the binding affinity of the variant PD-1 polypeptide for the ectodomain of PD-L1 is greater than the binding affinity of the variant PD-1 polypeptide for the ectodomain of PD-L2 of the same species. In some examples, the binding affinity is at least or at least about 1.2-fold, 3-fold, 4-fold, 5-fold or more greater for PD-L1 than for PD-L2. In some embodiments, the variant PD-1 polypeptide exhibits a greater ratio of binding for the ectodomain of PD-L1 versus the ectodomain of PD-L2 compared to the ratio of binding of the unmodified or wild-type for PD-1 for the ectodomain of PD-L1 versus PD-L2. In some examples, the ratio is greater by at least or at least about 1.5-fold, 2.0-fold, 3.0-fold, 4.0-fold, 5-fold, 10-fold, 15-fold, 20-fold, 30-fold, 40-fold, 50-fold or more. In some embodiments, binding affinity is determined by Mean Fluorescence Intensity (MFI) as measured by flow cytometry.

In some of any such embodiments, the variant PD-1 polypeptide lacks the PD-1 transmembrane domain and intracellular signaling domain; and/or the variant PD-1 polypeptide is not capable of being expressed on the surface of a cell. In some embodiments, the variant PD-1 polypeptide is a soluble protein.

In some of any such embodiments, the variant PD-1 polypeptide is linked to a moiety that increases biological half-life of the polypeptide. In some embodiments, the variant PD-1 polypeptide is linked to a multimerization domain. In some cases, the multimerization domain is an Fc domain or is a variant Fc domain with reduced effector function.

In some of any such embodiments, the variant PD-1 polypeptide is a transmembrane immunomodulatory protein, wherein the variant PD-1 polypeptide further contains a transmembrane domain and/or a cytoplasmic signaling domain.

Provided herein are immunomodulatory proteins containing any of the first variant PD-1 polypeptides provided herein and any of the second variant PD-1 polypeptides provided herein. In some embodiments, the first and second variant PD-1 polypeptides are linked indirectly via a linker. In some examples, the first and second variant PD-1 polypeptide are each linked to a multimerization domain, whereby the immunomodulatory protein is a multimer including the first and second variant PD-1 polypeptide. In some embodiments, the multimer is a dimer, optionally a homodimer. In some examples, the first variant PD-1 polypeptide and the second variant PD-1 polypeptide are the same.

Provided herein are immunomodulatory proteins containing any of the provided variant PD-1 polypeptides and any of the provided second polypeptides that are capable of specifically binding to CD28, optionally human CD28.

Provided herein are immunomodulatory proteins containing (1) a variant PD-1 polypeptide containing an extracellular domain or a portion thereof containing the IgV domain or specific binding fragment thereof, wherein the variant PD-1 polypeptide exhibits increased binding affinity for the ectodomain of PD-L1 compared to the binding affinity of the unmodified PD-1 polypeptide for the ectodomain of PD-L1, and (2) a CD28-binding polypeptide that is capable of specifically binding to CD28, optionally human CD28. In some examples, the binding affinity is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 60-fold, 80-fold, 100-fold, 150-fold, 200-fold, 250-fold, 300-fold, 400-fold, or 450-fold compared to binding affinity of the unmodified PD-1 for the ectodomain of PD-L1.

In some embodiments, the variant PD-1 polypeptide includes one or more amino acid modifications in an unmodified PD-1 polypeptide or a specific binding fragment thereof corresponding to amino acid modification(s) selected from an amino acid substitution P8T, D9E, D9G, D9N, D9V, P11A, W12G, W12L, W12R, N13D, N13S, N13Y, P14H, P14L, P14S, T16A, T16I, T16S, F17I, F17L, F17V, F17Y, S18T, A20S, A20T, A20V, L21V, L22I, V23E, V23G, V24L, T25A, D28E, N29D, N29S, A30V, T31I, T31N, T31S, T33I, C34Y, S35N, F36I, F36L, F36Y, S37P, S37T, N38D, N38S, N38T, T39A, T39R, T39S, S40P, S40T, E41D, E41V, S42G, S42R, F43L, F43Y, V44H, V44M, V44R, L45I, L45V, N46I, N46V, Y48F, Y48H, Y48N, R49Y, R49L, M50D, M50E, M50I, M50L, M50Q, M50V, M50T, S51G, P52A, P52L, S53G, S53N, S53T, N54C, N54H, N54D, N54G, N54S, N54Y, Q55E, Q55H, Q55K, Q55R, T56A, T56L, T56M, T56P, T56S, T56V, D57F, D57R, D57V, D57Y, K58L, K58R, K58T, L59M, L59R, L59V, A61L, A61S, E64D, E64K, R66H, R66S, S67C, S67G, S67I, S67N, S67R, Q68E, Q68I, Q68L, Q68P, Q68R, Q68T, P69H, P69L, P69S, G70C, G70E, G70F, G70I, G70L, G70N, G70R, G70V, G70S, Q71H, Q71K, Q71L, Q71P, Q71R, D72A, D72G, D72N, C73A, C73G, C73H, C73P, C73S, C73R, C73Y, F75Y, R76G, R76H, R76S, V77D, V77I, T78I, T78S, Q79A, Q79P, Q79R, L80Q, P81S, N82S, R84H, R84Q, D85G, D85N, F86Y, H87L, H87Q, H87R, M88L, M88F, S89G, S89N, V90L, V90M, V91A, V91D, V91I, R92G, R92N, R92S, A93V, R94Q, R95L, R95K, R95G, N96D, N96S, N96T, T100A, T100I, T100S, Y101F, L102F, L102I, L102Y, L102V, G104A, G104T, G104S, G104V, A105C, A105G, A105I, A105L, A105V, I106L, S107A, S107F, S107L, S107T, S107V, L108F, L108I, L108T, L108Y, A109D, A109G, A109H, A109S, P110A, K111E, K111G, K111I, K111M, K111N, K111R, K111T, K111V, A112I, A112P, A112V, Q113R, Q113W, I114T, K115D, K115E, K115IN, K115N, K115Q, K115R, E116D, R119G, R119H, R119L, R119P, R119Q, R119W, A120V, T125A, T125K, T125I, T125S, T125V, R127F, R127L, R127K, R127S, R127V, R128G, R128M, A129S, E130K, V131A, V131E, V131I, V131R, P132H, P132R, P132S, P132T, T133A, T133R, T133S, A134D, A134V, H135N, H135R, H135Y, P136L, P136T, S137C, P138S, P138T, S139T, P140A, P140L, P140R, R141G, R141M, R141S, R141W, P142A, P142L, P142R, P142T, A143D, A143S, A143V, G144D, or G144S with reference to numbering of positions set forth in SEQ ID NO:37, or a conservative amino acid substitution thereof.

In some embodiments, the variant PD-1 polypeptide includes an amino acid modification at one or more positions corresponding to an amino acid position 73, 86, 107, 112, 115, 119 or 120, with reference to numbering set forth in SEQ ID NO:37. In some examples, the variant PD-1 polypeptide or a specific binding fragment thereof corresponding to amino acid modification(s) selected from C73A, C73G, C73H, C73P, C73R, C73S, C73Y, F86Y, S107T, A112V, K115D, K115E, K115I, K115N, K115Q, R119H, R119L, R119P, R119Q, R119W or A120V.

In some embodiments, the variant PD-1 polypeptide contains 1, 2, 3, 4, 5, 6, 7, 8, 9, 10, 11, 12, 13, 14, 15, 16, 17, 18, 19 or 20 amino acid modifications, optionally wherein the amino acid modification is an amino acid substitution. In some embodiments, the variant PD-1 polypeptide contains one or more amino acid modifications in an unmodified PD-1 polypeptide or a specific binding fragment thereof corresponding to amino acid modification(s) selected from A112V/R119L/A120V; N13S/A120V/P142A; C34Y/N54D/T100S/A112V/A120V; M50V/S67N/L80Q/A120V/A143S; A112V/R119W; R84H/H87L/A112V/R119W; Q71R/V91I/A112V/R119L/A120V/T125S; A112V/K115E; M50L/L59V/R66H/A112V/H135Y/P138T/P142L; R119W; S53G/Q55R/A112V/K115E/A120V/S139T; R119W/H135R; A120V/T125I; A112V/A120V/V131A; F17I/K111E/A112V/A120V; S18T/R119Q/R141M; F36L/S37T/A112V/H135N/P138S; A112I/T125I; M50I/A112V/A120V; S67N/C73R/A93V/A112V/A120V; D72G/A112V/A120V; N96D/A112V/A120V/T125S; F86Y/R119W/T125I; R119P/T133R; K111M/A112V/K115E/P132H; S67G/A112V/T125I/T133S; A112V/A120V; S37P/A112V/R119W; W12L/S37P/A112V/R119W; D9G/A112V/A120V; T31S/S37T/A112V/T125I/A143S; S37T/A112V/T125I; R92G/A112V/A120V; E64D/F86Y/A112V/A120V; H87R/A112V/R119W; N13D/A105V/A112V/A120V/A134D; A112V/R119L/A120V/S137C; T16I/M50I/A112V/A120V; M50L/A112V/R119Q/A120V/T125I/H135R; D57V/A112V; S67N/R119W; S67N/A112V/A120V; N54Y/A112V/P140A; F43Y/P69L/R119W; N54Y/A112V/R119W; T56M/C73S/R76H/A112V/R119L/A120V/P132T/R141W; F17I/S40P/E41D/S67N/R95L/A112V/A120V/T125I/R141M; F17L/T31S/S35N/P81S/N96S/A112V/R119W; F43L/S67N/C73R/A112V/A120V; W12L/N38D/A112V/R119Q/A120V/P142T; S67N/P69H/C73R/Q79P/V91D/A112V/A120V/P136T/A143D; F17I/S40P/S67N/Q79R/A112V/R119W/T125I; F43Y/M50V/S67N/C73R/R92G/A112V/A120V/P136T; F17L/T56M/S67N/A112V/R119W/A120V/P142R; W12L/N54Y/S67N/F75Y/V91D/R95L/G104A/A112V/R119W/R141M; F17L/S37T/S67N/T78S/F86Y/A112V/R119H/A120V/V131E/A143V; N13D/S40P/A112V/R119L/A120V/S137C; F17V/A30V/E41V/R76S/A112V/R119Q/A120V/V131A; F17I/T25A/M50V/S53T/R66S/S67R/S107T/A112V/R119W/A143V; N13D/S40P/S67N/C73R/R95L/G104A/A112V/A120V; S40P/T56A/S67N/C73R/A112V/R119Q/A120V/V131A; N13Y/S40P/F43L/Q68P/R92G/A112V/R119L/A120V; F17L/S67N/Q71L/C73S/A112V/R119Q/A120V/P142L; F17I/S40P/P69S/C73S/N96S/G104A/A112V/A120V; F17I/S40P/A112V/R119L/A120V/P140R;A112V/A120V/T133S; A20S/S67N/C73R/R94Q/A112V/R119Q/A120V/T125I/P132S; N13D/S67N/C73R/R95L/A112V/R119Q/A120V/T125I; S40P/S67N/C73R/N96T/A112V/A120V; L21V/S40P/R95L/G104A/A112V/A120V/A129S/V131A/R141G; P14S/S40P/S42R/P52A/T56M/A112V/R119W/T125I/P142A; S40P/F43L/T56A/S67N/C73S/A112V/R119L/A120V; F17I/S40P/M50V/S67N/C73S/R95L/G104A/A112V/R119L/A120V; S40P/T56M/C73S/R95L/A112V/R119W/T125I/V131A/R141W; F17I/A20V/S51G/N54D/F86Y/A112V/A120V/T125I; F17I/T31N/T56M/S67N/C73R/G104A/A112V/R119Q/A120V/T133A/P140L; F17V/S40P/R92G/R95L/A112V/R119W; W12G/F17L/T56V/S67N/A112V/R119W/V131E/R141S; F86Y/R92G/A112V/R119L/A120V/T125K/T133S; P8T/F17I/S67N/F86Y/G104A/A112V/A120V/S139T; F17I/S40P/A112V/R119W/G144D L22I/S67I/G70S/Q71R/S107T/A112V/R119L/A120V/T125I/T133S; S40P/A112V/A120V; T16S/S67N/C73R/A112V/R119W; N13D/S40P/A112V/A120V/T125I/T133S; M50L/V91D/A112V/R119W/P132R/R141G; F17I/S40P/M50I/S67R/A112V/R119L/A120V/S137C; S40P/A112V/R119W; F17I/V24L/A112V/R119W; S40P/S67N/C73R/A93V/A112V/A120V; N13D/F17I/A112V/R119W/R141M; S67N/C73R/A112V/A120V/R141S; W12R/L59V/R66H/F86Y/V90L/A112V/K115N/R119L/A120V; F36L/M50I/S51G/C73R/S107T/K111M/A120V/V131E; M50V/R119W/A120V/T125I/R141G; A109G/A112V/K115E/R119W; Q55R/R76H/A112V/K115I/A120V; W12R/F86Y/R95L/A112V/R119P/T133R; S67N/C73Y/A112V; F17I/S40P/T56S/A112V; W12L/P14S/M50V/S67R/A93V/R94Q/K111T/A112V/R119W/A120V; F36L/L59R/S67N/A105L/A112V/R119W/A120V/A143V; L59M/E64K/F86Y/R94Q/A112V/R119L/A120V/T125I/T133S; P14H/F17Y/T39R/S40T/K58R/V77D/G104V/A112V/Q113R/I114T/A143V; D57V/L59M/P69S/C73S/A112V/R119L/A120V/A134V; V23E/T39S/S40P/C73Y/V91A/R92N/L102F/A112V/R119W/A120V; T16A/F17I/F36L/S67N/C73R/H87L/R92G/R95L/A112V/R119W; C73S/A105V/A112V/R119W/A120V/T133A; P14S/M50L/L59V/R66H/G70S/C73R/A112V/A120V/T125I/G144S; P8T/S40P/S53N/R95L/A112V/A120V/T125I/R128M/P138T/R141G; S37T/T56M/C73S/D85N/A109G/A112V/A120V/H135Y/A143S; S67N/C73R/A93V/G104A/A112V/R119Q/R127S/H135R; S40P/S67N/C73R/A112V/A120V; S67N/C73R/A93V/A112V/R119W; C73R/A93V/A112V/R119W; S67N/C73R/A112V/A120V; N13D/P69H/C73R/A93V/A112V/R119W/R141S; F17I/N38D/S40P/S67N/C73R/A112V/A120V; N13D/F17I/S40P/T56M/R66S/S67N/G70C/A112V/A120V/R141S; S40P/F43L/R66S/S67N/G70C/A112V/R119L/A120V; V23G/S40T/G104A/A112V/R119L/A120V; W12R/F36I/N54Y/S67I/C73S/A93V/G104A/A112V/K115Q/R119W; S40P/M50L/S67I/C73S/R92G/A93V/A112V/A120V/R141S; F17I/T25A/S40P/F43Y/S67N/C73R/F86Y/A112V/R119W/T125I; F17I/S40P/M50L/S67I/C73S/A112V/A120V/E130K/P136L; W12R/S40P/S67N/C73R/A93V/A112V/A120V/R141S; F17I/S40P/M50L/S67I/C73S/R92G/A93V/A112V/A120V/R141S; F17I/S40P/M50L/S67I/A112V/A120V/R141S; V23 G/T56P/S67I/C73S/F86Y/R92G/G104A/A112V/R119W/A143D; F17I/S40P/M50L/S67I/C73S/R92G/A93V/A112V/R119W/T125I; D9V/P11A/N13D/S40T/T56M/S67N/R95L/G104A/A112V/R119L/A120V; F17I/T25A/S40P/F43Y/S67N/A112V/R119L/A120V; D9E/F17I/S40P/M50L/S67I/C73S/V90M/T100A/G104A/K111M/A112V/R119W/A120V/A143D; F17I/S40P/M50L/S67I/C73S/R92G/A93V/A112V/A120V/R141G; F17I/S40P/S67N/S89G/R95L/A112V/R119W/T125I; F17I/S40P/M50L/S67I/C73S/R92G/A93V/K111M/A112V/R119Q/

A120V; D9N/F17I/T31N/S40P/M50L/S67I/C73S/R92G/ A93V/A112V/A120V/R141S; N13D/S40T/T56M/S67N/ R95L/G104A/K111R/A112V/A120V/T125I; W12G/F17I/ S40P/M50L/A112V/P132T; D9N/F17I/S40P/M50T/T56A/ G70S/C73R/R92G/A93V/A112V/A120V/R141S; N38S/ L59M/Q71L/S107T/A112V/K115E/R119Q/A120V; M50V/ L59M/A112V/R119Q/A120V P81S/F86Y/R92S/S107T/ A112V/K115E/A120V; C73R/R84Q/F86Y/S107T/A112V/ K115D/A120V; W12G/M50T/S53N/S67R/G70S/C73R/ G104V/A112V/K115E/R119W; T31I/F36Y/F43Y/S67N/ G70S/C73R/V90M/A112V/R119W; R76S/S107T/K111N/ A112V/K115N/A120V; F86Y/A112V/R119W/A120V; N13S/M50I/R76S/S107T/A112V/K115N/R119W/A120V; P14H/T16S/M50L/C73R/R84Q/F86Y/S107T/A112V/ K115E/A120V; F17L/T25A/L59M/E64K/F86Y/R94Q/ S107T/A112V/K115N/R119W/A120V; Q71R/F86Y/ A112V/K115E/R119Q/A120V; R76S/S107T/A112V/ K115N/R119W/A120V; M50I/A112V/K115D/A120V; M50V/P81S/F86Y/R92S/S107T/A112V/K115E/A120V; M50I/S67N/G70R/K111T/A112V/R119W/A120V; P14H/ T16S/M50L/L80Q/K111M/R119Q/A120V; T3H/F36Y/ E64K/A112V/K115E/R119Q/A120V; S107T/A112V/ R119W/A120V; T56S/A112V/K115E/A120V; T56S/ A112V/R119W; N46I/Y48N/D57Y/S67C/V90L/A112V; T56S/A112V/R119P; P14H/F17I/V44M/A112V/K115E/A120V; N38S/T56S/A112V/K115E/A120V; S42G/M50L/P69S/F86Y/A112V/K115E; P14H/T56S/A112V/K115E/A120V; N13S/S67N/G70C/F86Y/S89N/V91D/A112V/R119L/A120V; W12G/S67N/Q71R/F86Y/K111M/A112V/K115Q/R119W; S67N/C73R/V91D/S107T/K111M/A112V/K115Q/R119W; N13S/M50I/R76S/S107T/K111M/A112V/K115Q/R119W; T33I/S67N/G70S/S107T/K111N/A112V/K115E/R119W; P69L/F86Y/V90M/T100I/S107T/K111N/A112V/K115N/A120V; F17L/T25A/P69L/F86Y/V90M/T100I/S107T/K111N/A112V/K115N/A120V; T33I/M50I/R76S/F86Y/S107T/A112V/K115N/R119W/A120V; N13S/S67N/C73R/F86Y/S107T/A112V/Q113R/K115E/A120V; S67N/C73R/F86Y/V91D/S107T/A112V/K115D/A120V; F17L/T25A/S67N/C73R/R84Q/F86Y/A93V/A112V/K115E/R119W; T56S/A112V/K115E P69L/V91D/A112V/K115N/R119W/A120V; N13S/E41D/M50I/G70V/D72N/F86Y/R94Q/A112V/R119L/A120V; M50I/P69L/F86Y/V90M/T100I/S107T/K111N/A112V/K115N/A120V; M50I/C73R/S107T/K111N/A112V/K115N/A120V; F86Y/A112V/K115N/R119W; M50I/S67N/C73R/F86Y/R95L/S107T/A112V/K115N/R119W; M50L/Q68R/P69S/F86Y/S107T/A112V/K115N/R119W; N38T/A112V/K115N/R119L/A120V; S67N/Q71H/F86Y/R95L/S107T/A112V/K115N/R119W; A20T/D28E/F36L/M50I/Q68R/P69S/F86Y/A112V/R119L/A120V; M50I/S67N/C73R/F86Y/R95L/A112V/Q113W/R119L/A120V; L59M/S67N/Q71L/C73R/R95L/S107T/A112V/K115N/R119W; P52L/S53N/C73S/A112V/E116D/R119W; Q71R/C73R/A112V/K115N/R119L/A120V; W12L/A20T/N29D/S37P/L59M/Q68R/P69S/F86Y/A112V/R119L/A120V; N46I/Y48F/D57V/P69L/A112V/K115N/R119W; M50I/S67N/C73R/F86Y/R95L/S107T/A112V/K115Q/R119Q/A120V; N54D/P69H/C73R/F86Y/R95L/S107T/A112V/K115N/R119W; T56S/Q71K/F86Y/R95L/S107T/A112V/K115N/R119W; C73A/F86Y/S107T/A112V/K115N/R119Q/A120V; C73R/F86Y/A105G/S107T/A112V/K115N/R119L/A120V; N54H/G70E/C73P/F86Y/A112V/K115D/R119L/A120V; C73G/F86Y/S107T/A112V/K115N/R119Q/A120V; N54S/C73G/F86Y/S107T/A112V/K115D/R119L/A120V; F86Y/S107T/A112V/K115D/R119W/A120V; G70E/C73P/F86Y/S107T/A112V/K115E/R119Q/A120V; C73G/F86Y/A105G/S107T/A112V/K115D/R119W; C73G/F86Y/S107T/A112V/K115D/R119L/A120V; C73S/F86Y/S107T/A112V/K115D/R119L/A120V; L45V/C73G/F86Y/G104A/S107T/A112V/K115N/R119W/A120V; C73P/F86Y/S107T/A112V/K115D/R119Q/A120V; C73S/F86Y/S107T/A112V/K115E/R119Q/A120V; C73S/F86Y/G104T/S107T/A112V/K115E/R119W/A120V; C73R/F86Y/S107T/K111R/A112V/K115D/A120V; P14L/C73G/F86Y/S107T/A112V/K115D/R119L/A120V; G70E/F86Y/S107T/A112V/K115D/R119L/A120V; C73G/F86Y/G104V/S107T/A112V/K115N/R119L/A120V; C73S/F86Y/G104S/S107T/L108F/A112V/K115D/R119L/A120V; C73S/F86Y/S107T/A112V/K115D/A120V; C73R/F86Y/S107T/A112V/K115D/R119L/A120V; C73S/F86Y/S107T/A112V/Q113R/K115D/R119L/A120V; C73S/F86Y/V91A/S107T/A112V/K115D/R119L/A120V; G70E/C73P/F86Y/A105G/S107T/A112V/K115D/R119Q/A120V; C73G/F86Y/A105G/S107T/A112V/K115D/R119L/A120V; C73G/F86Y/A105G/S107T/A112V/Q113R/K115D/R119L/A120V; F86Y/S107T/A112V/K115D/R119Q/A120V; C73R/F86Y/S107T/A112V/K115N/R119L/A120V; C73A/F86Y/S107T/A112V/Q113R/K115E/R119Q/A120V; C73R/F86Y/S107T/A112V/K115D/R119Q/A120V; C73G/F86Y/A112V/K115D/R119W/A120V; C73P/F86Y/A105G/S107T/A112V/Q113R/K115D/R119L/A120V; C73R/F86Y/A105G/S107T/A112V/K115D/R119L/A120V; C73A/F86Y/S107T/A112V/K115D/R119L/A120V; P69S/C73R/F86Y/S107T/A112V/K115D/R119W/A120V; C73S/F86Y/G104S/S107T/A112V/K115E/R119W/A120V; Q68R/C73S/F86Y/S107T/A112V/K115D/R119Q/A120V; C73R/F86Y/S107T/A112V/K115N/R119Q/A120V; G70E/C73R/F86Y/S107T/A112V/K115N/R119Q/A120V; C73S/F86Y/S107T/A112V/K115D/R119W/A120V; G70E/F86Y/G104T/I106L/S107T/L108T/A112V/K115N/R119L/A120V; C73H/F86Y/A105G/S107T/A112V/K115D/R119L/A120V; G70E/C73P/F86Y/A105C/S107T/A112V/K115D/R119L/A120V; G70E/C73P/F86Y/S107T/A112V/K115D/R119Q/A120V; C73S/F86Y/S107T/K111R/A112V/K115E/R119L/A120V; C73R/D85G/F86Y/A105G/S107T/A112V/K115D/R119Q/A120V; C73R/F86Y/S107T/A112V/K115E/R119W/A120V; N54S/C73G/F86Y/S107T/A112V/K115E/R119Q/A120V; C73S/F86Y/G104S/S107T/A112V/K115N/R119L/A120V; F17L/Q71R/C73G/F86Y/A105G/S107T/A112V/K115D/R119L/A120V; C73G/F86Y/S107T/A112V/K115E/R119W/A120V; G70E/C73G/F86Y/A105C/S107T/A112V/K115E/R119L/A120V; C73G/F86Y/G104A/S107T/A112V/K115D/R119W/A120V; C73S/F86Y/S107T/A112V/K115N/A120V; C73P/F86Y/S107T/A112V/K115N/R119L/A120V; W12R/F86Y/S107T/A112V/K115D/R119Q/A120V; G70E/C73G/F86Y/A105L/A112V/K115N/R119Q/A120V; F86Y/S107T/A112V/K115N/R119W/A120V, with reference to numbering of positions set forth in SEQ ID NO:37. In some embodiments, the variant PD-1 polypeptide contains the amino acid modifications V44H/L45V/N46I/Y48H/M50E/N54G/K58T/L102V/A105V/A112I, with reference to numbering of positions set forth in SEQ ID NO:37.

In some embodiments, the unmodified PD-1 includes (i) the sequence of amino acids set forth in SEQ ID NO:37, (ii) a sequence of amino acids that has at least 95% sequence identity to SEQ ID NO:37; or (iii) is a portion of (i) or (ii) containing an IgV domain or specific binding fragment thereof; or the unmodified PD-1 includes (i) the sequence of amino acids set forth in SEQ ID NO:392, (ii) a sequence of amino acids that has at least 95% sequence identity to SEQ ID NO:392; or (iii) is a portion of (i) or (ii) containing an IgV domain or specific binding fragment thereof; or the unmodified PD-1 includes (i) the sequence of amino acids set forth in SEQ ID NO:244, (ii) a sequence of amino acids that has at least 95% sequence identity to SEQ ID NO:244; or (iii) is a portion of (i) or (ii) containing an IgV domain or specific binding fragment thereof.

In some embodiments, the variant PD-1 polypeptide contains only the extracellular domain or a portion thereof containing the IgV domain or specific binding fragment thereof. In some embodiments, the CD28-binding polypeptide contains the extracellular domain or a portion thereof containing at least one immunoglobulin superfamily (IgSF) domain of an IgSF family member, or a variant thereof. In some examples, the IgSF family member is ICOSL, CD80 or CD86, or a variant thereof that binds CD28. In some embodiments, the CD28-binding polypeptide is or contains a variant IgSF family member, said variant IgSF family member including one more amino acid modifications in an unmodified IgSF family member that increases binding affinity for CD28 compared to the unmodified IgSF family member. In some embodiments, the CD28-binding polypeptide is or contains a variant ICOSL containing the extracellular domain or a portion thereof containing at least one IgSF domain, said variant ICOSL including one or more amino acid modifications in an unmodified ICOSL polypeptide that increases binding affinity for CD28 compared to the unmodified ICOSL polypeptide. In some embodiments, the CD28-binding polypeptide is or comprises a variant CD86 comprising the extracellular domain or a portion thereof containing at least one IgSF domain, said variant CD86 comprising one or more amino acid modifications in an unmodified CD86 polypeptide that increases binding affinity for CD28 compared to the unmodified CD86 polypeptide. In some embodiments, the increase in binding affinity for binding to CD28 is greater than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold.

In some embodiments, the second polypeptide is not the full-length sequence of the IgSF member; and/or the second polypeptide only contains the extracellular domain or at least one IgSF domain or specific binding fragment thereof of the IgSF member, optionally wherein the IgSF domain is an IgV domain or an IgC domain. In some embodiments, the at least one IgSF domain contains an IgV domain or specific binding fragment thereof, an IgC domain or a specific binding fragment thereof, or both. In some embodiments, the at least one IgSF domain consists of an IgV domain or specific binding fragment thereof, an IgC domain or a specific binding fragment thereof, or both.

In some embodiments, the variant PD-1 polypeptide and the CD28-binding polypeptide are linked directly or indirectly via a linker. In some examples, the linker is a peptide linker. In some cases, the peptide linker is selected from GGGGS (G4S; SEQ ID NO: 472), GSGGGGS (SEQ ID NO: 471), GGGGSGGGGS (2×GGGGS; SEQ ID NO: 474), GGGGSGGGGSGGGGS (3×GGGGS; SEQ ID NO: 473), or combinations thereof.

In some embodiments, the variant PD-1 is amino-terminal to the CD28-binding polypeptide. In some embodiments, the variant PD-1 polypeptide is carboxy-terminal to the CD28-binding polypeptide.

In some embodiments, the immunomodulatory protein is a monomer and/or includes a single polypeptide chain. In some embodiments, the immunomodulatory protein is a dimer, optionally wherein each polypeptide of the dimer is linked to a multimerization domain. In some cases, the immunomodulatory protein is a homodimer.

In some embodiments, the immunomodulatory protein includes a first polypeptide chain containing the variant PD-1 polypeptide, the CD28-binding polypeptide and a first multimerization domain, and a second polypeptide chain containing the variant PD-1 polypeptide, the CD28-binding polypeptide and a second multimerization domain, whereby the immunomodulatory protein is a multimer containing the first polypeptide and the second polypeptide. In some cases, the first and second multimerization domain are the same.

In some embodiments, the multimerization domain is an Fc domain of an immunoglobulin, optionally wherein the immunoglobulin protein is human and/or the Fc region is human. In some examples, the Fc domain is an IgG1, IgG2 or IgG4, or is a variant thereof with reduced effector function. In some cases, the Fc domain is an IgG1 Fc domain, optionally a human IgG1, or is a variant thereof with reduced effector function. In some examples, the Fc domain is a variant IgG1 including one or more amino acid substitutions and the one or more amino acid substitutions are selected from E233P, L234A, L234V, L235A, L235E, G236del, G237A, S267K, or N297G, each numbered according to EU index by Kabat. In some embodiments, the Fc domain includes the amino acid substitution N297G, the amino acid substitutions R292C/N297G/V302C, or the amino acid substitutions L234A/L235E/G237A, each numbered according to the EU index of Kabat. In some cases, the variant Fc region further contains the amino acid substitution C220S, wherein the residues are numbered according to the EU index of Kabat. In some cases, the Fc region includes K447del, wherein the residue is numbered according to the EU index of Kabat. In some embodiments, the Fc region includes the sequence of amino acids set forth in SEQ ID NO:384 or 476, or a sequence of amino acids that exhibits at least 85%, 86%, 87%, 88%, 89%, 90%, 91%, 92%, 93%, 94%, 95%, 96%, 97%, 98% or 99% sequence identity to SEQ ID NO:384 or 476, and contains the amino acid substitutions therein and/or exhibits reduced effector function.

In some embodiments, the immunomodulatory protein exhibits PD-L1-dependent CD28 costimulation.

Provided herein are conjugates containing any of the provided variant PD-1 polypeptides linked to a targeting moiety that specifically binds to a molecule on the surface of a cell. In some cases, the cell is an immune cell or is a tumor cell. In some examples, the moiety is a protein, peptide, nucleic acid, small molecule or nanoparticle. In some embodiments, the moiety is an antibody or antigen-binding fragment. In some embodiments, the conjugate is a fusion protein.

Provided herein are nucleic acid molecule(s) encoding any of the variant PD-1 polypeptides provided herein, any of the provided immunomodulatory proteins or a conjugate that is any of the provided fusion proteins. In some examples, the nucleic acid molecule is a synthetic nucleic acid. In some cases, the nucleic acid molecule is a cDNA.

Provided herein are vectors containing any of the provided nucleic acid molecules. In some examples, the vector is an expression vector. In some cases, the vector is a mammalian expression vector or a viral vector.

Provided herein are cells containing any of the vectors provided herein. In some embodiments, the cell is a mammalian cell. In some examples, the cell is a human cell.

Provided herein are methods of producing a protein containing a variant PD-1 polypeptide, including introducing any of provided nucleic acid molecules or vectors into a host cell under conditions to express the protein in the cell. In some embodiments, the method further includes isolating or purifying the protein from the cell.

Provided herein are methods of engineering a cell expressing a variant PD-1 variant polypeptide, the method including introducing a nucleic acid molecule encoding any of the provided variant PD-1 polypeptides, immunomodulatory proteins, or conjugates that is any of the provided fusion proteins into a host cell under conditions in which the polypeptide is expressed in the cell.

Provided herein are transmembrane immunomodulatory proteins (TIPs) comprising: an ectodomain comprising an extracellular domain or specific binding fragment thereof of a variant PD-1, wherein the extracellular domain or a portion thereof comprises an IgV domain or specific binding fragment thereof, wherein the variant PD-1 polypeptide exhibits increased binding affinity for the ectodomain of PD-L1 compared to the binding affinity of the unmodified PD-1 polypeptide for the ectodomain of PD-L1; a transmembrane domain; and an intracellular signaling domain comprising a signaling region of an activating receptor or one or more signaling region of costimulatory molecule. In some embodiments, the activating receptor is or comprises at least one ITAM (immunoreceptor tyrosine-based activation motif)-containing signaling domain. In some embodiments, the activating receptor is or comprises an intracellular signaling domain of a CD3-zeta chain, optionally wherein the CD3-zeta chain is a human CD3-zeta chain or comprises the sequence of amino acids set forth in SEQ ID NO: 607 or a sequence of amino acids that has at least 90% sequence identity to SEQ ID NO: 607. In some embodiments, the one or more signaling region of a costimulatory molecule is a signaling region of at least one of a CD28, an ICOS, or a 4-1BB. In some embodiments, the at least one of the costimulatory signaling region comprises a costimulatory signaling region of CD28. In some embodiments, the at least one of the costimulatory signaling region comprises a costimulatory signaling region of CD28 and 41BB. In some embodiments, the at least one of the costimulatory signaling region comprises a costimulatory signaling region of ICOS and 41BB. In some embodiments, the at least one of the costimulatory signaling region comprises a costimulatory signaling region of CD28, ICOS and 41BB. In some embodiments, at least one of the costimulatory signaling region is a costimulatory signaling region of a human CD28 or has the sequence of amino acids set forth in any of SEQ ID NO:614-616 or a sequence of amino acids that has at least 90% sequence identity to any of SEQ ID NOS: 614-616. In some embodiments, the at least one of the of the costimulatory signaling region is a costimulatory signaling region of a human 41BB or has the sequence of amino acids set forth in SEQ ID NO:613 or a sequence of amino acids that has at least 90% sequence identity to SEQ ID NOS: 613. In some embodiments, the at least one of the of the costimulatory signaling region is a costimulatory signaling region of a human ICOS or has the sequence of amino acids set forth in any of SEQ ID NO:992 or a sequence of amino acids that has at least 90% sequence identity to any of SEQ ID NOS: 992. In some embodiments, the TIP transmembrane domain is a transmembrane domain of a costimulatory molecule. In some embodiments, the transmembrane domain of the costimulatory molecule is a transmembrane domain of CD28, ICOS or 41BB. In some embodiments, the transmembrane domain and costimulatory signaling region is from the same costimulatory molecule.

In some embodiments, the TIP further comprises a spacer between the ectodomain and the transmembrane domain. In some embodiments, the spacer is from or from about 10 to 100 amino acids in length, from or from about 10 to 75 amino acids in length, from or from about 10 to 50 amino acids in length, from or from about 10 to 20 amino acids in length, from or from about 20 to 100 amino acids in length, from or from about 20 to 75 amino acids in length, from or from about 20 to 50 amino acids in length, from or from about 50 to 100 amino acids in length, from or from about 50 to 75 amino acids in length or from or from about 75 to 100 amino acids in length. In some embodiments, the spacer is from an immunoglobulin, optionally wherein the spacer comprises a hinge region of an immunoglobulin. In some embodiments, the spacer is or comprises a CD8 hinge or a variant thereof.

In some embodiments, the binding affinity of the TIP is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 60-fold, 80-fold, 100-fold, 150-fold, 200-fold, 250-fold, 300-fold, 400-fold, or 450-fold compared to binding affinity of a TIP containing an ecotodomain comprising the extracellular domain or a portion thereof comprising an IgV domain or specific binding fragment thereof the unmodified or wild-type PD-1 for the ectodomain of PD-L1. In some embodiments, the TIP comprises one or more amino acid modifications in an unmodified (e.g. wild-type) PD-1 polypeptide or a specific binding fragment thereof corresponding to amino acid modification(s) selected from an amino acid substitution P8T, D9E, D9G, D9N, D9V, P11A, W12G, W12L, W12R, N13D, N13S, N13Y, P14H, P14L, P14S, T16A, T16I, T16S, F17I, F17L, F17V, F17Y, S18T, A20S, A20T, A20V, L21V, L22I, V23E, V23G, V24L, T25A, D28E, N29D, N29S, A30V, T31I, T31N, T31S, T33I, C34Y, S35N, F36I, F36L, F36Y, S37P, S37T, N38D, N38S, N38T, T39A, T39R, T39S, S40P, S40T, E41D, E41V, S42G, S42R, F43L, F43Y, V44H, V44M, V44R, L45I, L45V, N46I, N46V, Y48F, Y48H, Y48N, R49Y, R49L, M50D, M50E, M50I, M50L, M50Q, M50V, M50T, S51G, P52A, P52L, S53D, S53G, S53L, S53N, S53T, S53V, N54C, N54H, N54D, N54G, N54S, N54Y, Q55E, Q55H, Q55K, Q55R, T56A, T56L, T56M, T56P, T56S, T56V, D57F, D57R, D57V, D57Y, K58L, K58R, K58T, L59M, L59R, L59V, A61L, A61S, E64D, E64K, R66H, R66S, S67C, S67G, S67I, S67N, S67R, Q68E, Q68I, Q68L, Q68P, Q68R, Q68T, P69H, P69L, P69S, G70C, G70E, G70F, G70I, G70L, G70N, G70R, G70V, G70S, Q71H, Q71K, Q71L, Q71P, Q71R, D72A, D72G, D72N, C73A, C73G, C73H, C73P, C73S, C73R, C73Y, F75Y, R76G, R76H, R76S, V77D, V77I, T78I, T78S, Q79A, Q79P, Q79R, L80Q, P81S, N82S, R84H, R84Q, D85G, D85N, F86Y, H87L, H87Q, H87R, M88L, M88F, S89G, S89N, V90L, V90M, V91A, V91D, V91I, R92G, R92N, R92S, A93V, R94Q, R95L, R95K, R95G, N96D, N96S, N96T, T100A, T100I, T100S, Y101F, L102F, L102I, L102Y, L102V, G104A, G104T, G104S, G104V, A105C, A105G, A105I, A105L, A105V, I106L, S107A, S107F, S107L, S107T, S107V, L108F, L108I, L108T, L108Y, A109D, A109G, A109H, A109S, P110A, K111E, K111G, K111I, K111M, K111N, K111R, K111T, K111V, A112I, A112P, A112V, Q113R, Q113W, I114T, K115D, K115E, K115IN, K115N, K115Q, K115R, E116D, R119G, R119H, R119L, R119P, R119Q, R119W, A120V, T125A, T125K, T125I, T125S, T125V, R127F, R127L, R127K, R127S, R127V, R128G, R128M, A129S, E130K, V131A, V131E, V131I, V131R, P132H, P132R, P132S, P132T, T133A, T133R, T133S, A134D, A134V, H135N, H135R, H135Y, P136L, P136T, S137C, P138S, P138T, S139T, P140A, P140L, P140R, R141G, R141M, R141S, R141W, P142A, P142L, P142R, P142T, A143D, A143S, A143V, G144D, or G144S with reference to numbering of positions set forth in SEQ ID NO:37, or a conservative amino acid substitution thereof. In some embodiments, the variant PD-1 polypeptide comprises an amino acid modification at one or more positions corresponding to an amino acid position 73, 86, 107, 112, 115, 119 or 120, with reference to numbering set forth in SEQ ID NO:37. In some embodiments, the variant PD-1 polypeptide comprises one or more amino acid modifications in an unmodified PD-1 polypeptide or a specific binding fragment thereof corresponding to amino acid modification(s) selected from C73A, C73G, C73H, C73P, C73R, C73S, C73Y, F86Y, S107T, A112V, K115D, K115E, K115I, K115N, K115Q, R119H, R119L, R119P, R119Q, R119W or A120V, with reference to numbering of positions set forth in SEQ ID NO: 37. In some embodiments, the variant PD-1 polypeptide comprises 1, 2, 3, 4, 5, 6, 7, 8, 9, 10, 11, 12, 13, 14, 15, 16, 17, 18, 19 or 20 amino acid modifications, optionally wherein the amino acid modification is an amino acid substitution. In some embodiments, the variant PD-1 polypeptide comprises one or more amino acid modifications in an unmodified PD-1 polypeptide or a specific binding fragment thereof corresponding to amino acid modification(s) selected from A112V/R119L/A120V; N13S/A120V/P142A; C34Y/N54D/T100S/A112V/A120V; M50V/S67N/L80Q/A120V/A143S; A112V/R119W; R84H/H87L/A112V/R119W; Q71R/V91I/A112V/R119L/A120V/T125S; A112V/K115E; M50L/L59V/R66H/A112V/H135Y/P138T/P142L; R119W; S53G/Q55R/A112V/K115E/A120V/S139T; R119W/H135R; A120V/T125I; A112V/A120V/V131A; F17I/K111E/A112V/A120V; S18T/R119Q/R141M; F36L/S37T/A112V/H135N/P138S; A112V/T125I; M50I/A112V/A120V; S67N/C73R/A93V/A112V/A120V; D72G/A112V/A120V; N96D/A112V/A120V/T125S; F86Y/R119W/T125I; R119P/T133R; K111M/A112V/K115E/P132H; S67G/A112V/T125I/T133S; A112V/A120V; S37P/A112V/R119W; W12L/S37P/A112V/R119W; D9G/A112V/A120V; T31S/S37T/A112V/T125I/A143S; S37T/A112V/T125I; R92G/A112V/A120V; E64D/F86Y/A112V/A120V; H87R/A112V/R119W; N13D/A105V/A112V/A120V/A134D; A112V/R119L/A120V/S137C; T16I/M50I/A112V/A120V; M50L/A112V/R119Q/A120V/T125I/H135R; D57V/A112V; S67N/R119W; S67N/A112V/A120V; N54Y/A112V/P140A; F43Y/P69L/R119W; N54Y/A112V/R119W; T56M/C73S/R76H/A112V/R119L/A120V/P132T/R141W; F17I/S40P/E41D/S67N/R95L/A112V/A120V/T125I/R141M; F17L/T31S/S35N/P81S/N96S/A112V/R119W; F43L/S67N/C73R/A112V/A120V; W12L/N38D/A112V/R119Q/A120V/P142T; S67N/P69H/C73R/Q79P/V91D/A112V/A120V/P136T/A143D; F17I/S40P/S67N/Q79R/A112V/R119W/T125I; F43Y/M50V/S67N/C73R/R92G/A112V/A120V/P136T; F17L/T56M/S67N/A112V/R119W/A120V/P142R; W12L/N54Y/S67N/F75Y/V91D/R95L/G104A/A112V/R119W/R141M; F17L/S37T/S67N/T78S/F86Y/A112V/R119H/A120V/V131E/A143V; N13D/S40P/A112V/R119L/A120V/S137C; F17V/A30V/E41V/R76S/A112V/R119Q/A120V/V131A; F17I/T25A/M50V/S53T/R66S/S67R/S107T/A112V/R119W/A143V; N13D/S40P/S67N/C73R/R95L/G104A/A112V/A120V; S40P/T56A/S67N/C73R/A112V/R119Q/A120V/V131A; N13Y/S40P/F43L/Q68P/R92G/A112V/R119L/A120V; F17L/S67N/Q71L/C73S/A112V/R119Q/A120V/P142L; F17I/S40P/P69S/C73S/N96S/G104A/A112V/A120V; F17I/S40P/A112V/R119L/A120V/P140R; A112V/A120V/T133S; A20S/S67N/C73R/R94Q/A112V/R119Q/A120V/T125I/P132S; N13D/S67N/C73R/R95L/A112V/R119Q/A120V/T125I; S40P/S67N/C73R/N96T/A112V/A120V; L21V/S40P/R95L/G104A/A112V/A120V/A129S/V131A/R141G; P14S/S40P/S42R/P52A/T56M/A112V/R119W/T125I/P142A; S40P/F43L/T56A/S67N/C73S/A112V/R119L/A120V; F17I/S40P/M50V/S67N/C73S/R95L/G104A/A112V/R119L/A120V; S40P/T56M/C73S/R95L/A112V/R119W/T125I/V131A/R141W; F17I/A20V/S51G/N54D/F86Y/A112V/A120V/T125I; F17I/T31N/T56M/S67N/C73R/G104A/A112V/R119Q/A120V/T133A/P140L; F17V/S40P/R92G/R95L/A112V/R119W; W12G/F17L/T56V/S67N/A112V/R119W/V131E/R141S; F86Y/R92G/A112V/R119L/A120V/T125K/T133S; P8T/F17I/S67N/F86Y/G104A/A112V/A120V/S139T; F17I/S40P/A112V/R119W/G144D L22I/S67I/G70S/Q71R/S107T/A112V/R119L/A120V/T125I/T133S; S40P/A112V/A120V; T16S/S67N/C73R/A112V/R119W; N13D/S40P/A112V/A120V/T125I/T133S; M50L/V91D/A112V/R119W/P132R/R141G; F17I/S40P/M50I/S67R/A112V/R119L/A120V/S137C; S40P/A112V/R119W; F17I/V24L/A112V/R119W; S40P/S67N/C73R/A93V/A112V/A120V; N13D/F17I/A112V/R119W/R141M; S67N/C73R/A112V/A120V/R141S; W12R/L59V/R66H/F86Y/V90L/A112V/K115N/R119L/A120V; F36L/M50I/S51G/C73R/S107T/K111M/A120V/V131E; M50V/R119W/A120V/T125I/R141G; A109G/A112V/K115E/R119W; Q55R/R76H/A112V/K115I/A120V; W12R/F86Y/R95L/A112V/R119P/T133R; S67N/C73Y/A112V; F17I/S40P/T56S/A112V; W12L/P14S/M50V/S67R/A93V/R94Q/K111T/A112V/R119W/A120V; F36L/L59R/S67N/A105L/A112V/R119W/A120V/A143V; L59M/E64K/F86Y/R94Q/A112V/R119L/A120V/T125I/T133S; P14H/F17Y/T39R/S40T/K58R/V77D/G104V/A112V/Q113R/I114T/A143V; D57V/L59M/P69S/C73S/A112V/R119L/A120V/A134V; V23E/T39S/S40P/C73Y/V91A/R92N/L102F/A112V/R119W/A120V; T16A/F17I/F36L/S67N/C73R/H87L/R92G/R95L/A112V/R119W; C73S/A105V/A112V/R119W/A120V/T133A; P14S/M50L/L59V/R66H/G70S/C73R/A112V/A120V/T125I/G144S; P8T/S40P/S53N/R95L/A112V/A120V/T125I/R128M/P138T/R141G; S37T/T56M/C73S/D85N/A109G/A112V/A120V/H135Y/A143S; S67N/C73R/A93V/G104A/A112V/R119Q/R127S/H135R; S40P/S67N/C73R/A112V/A120V; S67N/C73R/A93V/A112V/R119W; C73R/A93V/A112V/R119W; S67N/C73R/A112V/A120V; N13D/P69H/C73R/A93V/A112V/R119W/R141S; F17I/N38D/S40P/S67N/C73R/A112V/A120V; N13D/F17I/S40P/T56M/R66S/S67N/G70C/A112V/A120V/R141S; S40P/F43L/R66S/S67N/G70C/A112V/R119L/A120V; V23G/S40T/G104A/A112V/R119L/A120V; W12R/F36I/N54Y/S67I/C73S/A93V/G104A/A112V/K115Q/R119W; S40P/M50L/S67I/C73S/R92G/A93V/A112V/A120V/R141S; F17I/T25A/S40P/F43Y/S67N/C73R/F86Y/A112V/R119W/T125I; F17I/S40P/M50L/S67I/C73S/A112V/A120V/E130K/P136L; W12R/S40P/S67N/C73R/A93V/A112V/A120V/R141S; F17I/S40P/M50L/S67I/C73S/R92G/A93V/A112V/A120V/R141S; F17I/S40P/M50L/S67I/A112V/A120V/R141S; V23 G/T56P/S67I/C73S/F86Y/R92G/G104A/A112V/R119W/A143D; F17I/S40P/M50L/S67I/C73S/R92G/A93V/A112V/R119W/T125I; D9V/P11A/N13D/S40T/T56M/S67N/R95L/G104A/A112V/R119L/A120V; F17I/T25A/S40P/F43Y/S67N/A112V/R119L/A120V; D9E/F17I/S40P/M50L/S67I/C73S/V90M/T100A/G104A/K111M/A112V/R119W/A120V/A143D; F17I/S40P/M50L/S67I/C73S/R92G/A93V/A112V/A120V/R141G; F17I/S40P/S67N/S89G/R95L/A112V/R119W/T125I; F17I/S40P/M50L/S67I/C73S/R92G/A93V/K111M/A112V/R119Q/A120V; D9N/F17I/T31N/S40P/M50L/S67I/C73S/R92G/A93V/A112V/A120V/R141S; N13D/S40T/T56M/S67N/R95L/G104A/K111R/A112V/A120V/T125I; W12G/F17I/S40P/M50L/A112V/P132T; D9N/F17I/S40P/M50T/T56A/G70S/C73R/R92G/A93V/A112V/A120V/R141S; N38S/

L59M/Q71L/S107T/A112V/K115E/R119Q/A120V; M50V/ L59M/A112V/R119Q/A120V; P81S/F86Y/R92S/S107T/ A112V/K115E/A120V; C73R/R84Q/F86Y/S107T/A112V/ K115D/A120V; W12G/M50T/S53N/S67R/G70S/C73R/ G104V/A112V/K115E/R119W; T31I/F36Y/F43Y/S67N/ G70S/C73R/V90M/A112V/R119W; R76S/S107T/K111N/ A112V/K115N/A120V; F86Y/A112V/R119W/A120V; N13S/M50I/R76S/S107T/A112V/K115N/R119W/A120V; P14H/T16S/M50L/C73R/R84Q/F86Y/S107T/A112V/ K115E/A120V; F17L/T25A/L59M/E64K/F86Y/R94Q/ S107T/A112V/K115N/R119W/A120V; Q71R/F86Y/ A112V/K115E/R119Q/A120V; R76S/S107T/A112V/ K115N/R119W/A120V; M50I/A112V/K115D/A120V; M50V/P81S/F86Y/R92S/S107T/A112V/K115E/A120V; M50I/S67N/G70R/K111T/A112V/R119W/A120V; P14H/ T16S/M50L/L80Q/K111M/R119Q/A120V; T31I/F36Y/ E64K/A112V/K115E/R119Q/A120V; S107T/A112V/ R119W/A120V; T56S/A112V/K115E/A120V; T56S/ A112V/R119W; N46I/Y48N/D57Y/S67C/V90L/A112V; T56S/A112V/R119P; P14H/F17I/V44M/A112V/K115E/ A120V; N38S/T56S/A112V/K115E/A120V; S42G/M50L/ P69S/F86Y/A112V/K115E; P14H/T56S/A112V/K115E/ A120V; N13S/S67N/G70C/F86Y/S89N/V91D/A112V/ R119L/A120V; W12G/S67N/Q71R/F86Y/K111M/A112V/ K115Q/R119W; S67N/C73R/V91D/S107T/K111M/ A112V/K115Q/R119W; N13S/M50I/R76S/S107T/K111M/ A112V/K115Q/R119W; T33I/S67N/G70S/S107T/K111N/ A112V/K115E/R119W; P69L/F86Y/V90M/T100I/S107T/ K111N/A112V/K115N/A120V; F17L/T25A/P69L/F86Y/ V90M/T100I/S107T/K111N/A112V/K115N/A120V; T33I/ M50I/R76S/F86Y/S107T/A112V/K115N/R119W/A120V; N13S/S67N/C73R/F86Y/S107T/A112V/Q113R/K115E/ A120V; S67N/C73R/F86Y/V91D/S107T/A112V/K115D/ A120V; F17L/T25A/S67N/C73R/R84Q/F86Y/A93V/ A112V/K115E/R119W; T56S/A112V/K115E P69L/V91D/ A112V/K115N/R119W/A120V; N13S/E41D/M50I/G70V/ D72N/F86Y/R94Q/A112V/R119L/A120V; M50I/P69L/ F86Y/V90M/T100I/S107T/K111N/A112V/K115N/A120V; M50I/C73R/S107T/K111N/A112V/K115N/A120V; F86Y/ A112V/K115N/R119W; M50I/S67N/C73R/F86Y/R95L/ S107T/A112V/K115N/R119W; M50L/Q68R/P69S/F86Y/ S107T/A112V/K115N/R119W; N38T/A112V/K115N/ R119L/A120V; S67N/Q71H/F86Y/R95L/S107T/A112V/ K115N/R119W; A20T/D28E/F36L/M50I/Q68R/P69S/ F86Y/A112V/R119L/A120V; M50I/S67N/C73R/F86Y/ R95L/A112V/Q113W/R119L/A120V; L59M/S67N/Q71L/ C73R/R95L/S107T/A112V/K115N/R119W; P52L/S53N/ C73S/A112V/E116D/R119W; Q71R/C73R/A112V/K115N/ R119L/A120V; W12L/A20T/N29D/S37P/L59M/Q68R/ P69S/F86Y/A112V/R119L/A120V; N46I/Y48F/D57V/ P69L/A112V/K115N/R119W; M50I/S67N/C73R/F86Y/ R95L/S107T/A112V/K115Q/R119Q/A120V; N54D/P69H/ C73R/F86Y/R95L/S107T/A112V/K115N/R119W; T56S/ Q71K/F86Y/R95L/S107T/A112V/K115N/R119W; C73A/ F86Y/S107T/A112V/K115N/R119Q/A120V; C73R/F86Y/ A105G/S107T/A112V/K115N/R119L/A120V; N54H/ G70E/C73P/F86Y/A112V/K115D/R119L/A120V; C73G/ F86Y/S107T/A112V/K115N/R119Q/A120V; N54S/C73G/ F86Y/S107T/A112V/K115D/R119L/A120V; F86Y/S107T/ A112V/K115D/R119W/A120V; G70E/C73P/F86Y/S107T/ A112V/K115E/R119Q/A120V; C73G/F86Y/A105G/ S107T/A112V/K115D/R119W; C73G/F86Y/S107T/ A112V/K115D/R119L/A120V; C73S/F86Y/S107T/A112V/ K115D/R119L/A120V; L45V/C73G/F86Y/G104A/S107T/ A112V/K115N/R119W/A120V; C73P/F86Y/S107T/ A112V/K115D/R119Q/A120V; C73S/F86Y/S107T/ A112V/K115E/R119Q/A120V; C73S/F86Y/G104T/S107T/ A112V/K115E/R119W/A120V; C73R/F86Y/S107T/ K111R/A112V/K115D/A120V; P14L/C73G/F86Y/S107T/ A112V/K115D/R119L/A120V; G70E/F86Y/S107T/ A112V/K115D/R119L/A120V; C73G/F86Y/G104V/ S107T/A112V/K115N/R119L/A120V; C73S/F86Y/G104S/ S107T/L108F/A112V/K115D/R119L/A120V; C73S/F86Y/ S107T/A112V/K115D/A120V; C73R/F86Y/S107T/A112V/ K115D/R119L/A120V; C73S/F86Y/S107T/A112V/Q113R/ K115D/R119L/A120V; C73S/F86Y/V91A/S107T/A112V/ K115D/R119L/A120V; G70E/C73P/F86Y/A105G/S107T/ A112V/K115D/R119Q/A120V; C73G/F86Y/A105G/ S107T/A112V/K115D/R119L/A120V; C73G/F86Y/ A105G/S107T/A112V/Q113R/K115D/R119L/A120V; F86Y/S107T/A112V/K115D/R119Q/A120V; C73R/F86Y/ S107T/A112V/K115N/R119L/A120V; C73A/F86Y/S107T/ A112V/Q113R/K115E/R119Q/A120V; C73R/F86Y/S107T/ A112V/K115D/R119Q/A120V; C73G/F86Y/A112V/ K115D/R119W/A120V; C73P/F86Y/A105G/S107T/ A112V/Q113R/K115D/R119L/A120V; C73R/F86Y/ A105G/S107T/A112V/K115D/R119L/A120V; C73A/ F86Y/S107T/A112V/K115D/R119L/A120V; P69S/C73R/ F86Y/S107T/A112V/K115D/R119W/A120V; C73S/F86Y/ G104S/S107T/A112V/K115E/R119W/A120V; Q68R/ C73S/F86Y/S107T/A112V/K115D/R119Q/A120V; C73R/ F86Y/S107T/A112V/K115N/R119Q/A120V; G70E/C73R/ F86Y/S107T/A112V/K115N/R119Q/A120V; C73S/F86Y/ S107T/A112V/K115D/R119W/A120V; G70E/F86Y/ G104T/I106L/S107T/L108T/A112V/K115N/R119L/ A120V; C73H/F86Y/A105G/S107T/A112V/K115D/ R119L/A120V; G70E/C73P/F86Y/A105C/S107T/A112V/ K115D/R119L/A120V; G70E/C73P/F86Y/S107T/A112V/ K115D/R119Q/A120V; C73S/F86Y/S107T/K111R/A112V/ K115E/R119L/A120V; C73R/D85G/F86Y/A105G/S107T/ A112V/K115D/R119Q/A120V; C73R/F86Y/S107T/ A112V/K115E/R119W/A120V; N54S/C73G/F86Y/S107T/ A112V/K115E/R119Q/A120V; C73S/F86Y/G104S/S107T/ A112V/K115N/R119L/A120V; F17L/Q71R/C73G/F86Y/ A105G/S107T/A112V/K115D/R119L/A120V; C73G/ F86Y/S107T/A112V/K115E/R119W/A120V; G70E/C73G/ F86Y/A105C/S107T/A112V/K115E/R119L/A120V; C73G/ F86Y/G104A/S107T/A112V/K115D/R119W/A120V; C73S/F86Y/S107T/A112V/K115N/A120V; C73P/F86Y/ S107T/A112V/K115N/R119L/A120V; W12R/F86Y/ S107T/A112V/K115D/R119Q/A120V; G70E/C73G/F86Y/ A105L/A112V/K115N/R119Q/A120V; F86Y/S107T/ A112V/K115N/R119W/A120V, with reference to numbering of positions set forth in SEQ ID NO:37. In some embodiments, the variant PD-1 polypeptide comprises the amino acid modifications V44H/L45V/N46I/Y48H/ M50EN54G/K58T/L102V/A105V/A112I, with reference to numbering of positions set forth in SEQ ID NO:37.

In some embodiments of the TIP, the unmodified PD-1 comprises (i) the sequence of amino acids set forth in SEQ ID NO: 37, (ii) a sequence of amino acids that has at least 95% sequence identity to SEQ ID NO: 37; or (iii) is a portion of (i) or (ii) comprising an IgV domain or specific binding fragment thereof; the unmodified PD-1 comprises (i) the sequence of amino acids set forth in SEQ ID NO: 392, (ii) a sequence of amino acids that has at least 95% sequence identity to SEQ ID NO: 392, or (iii) is a portion of (i) or (ii) comprising an IgV domain or specific binding fragment thereof; or the unmodified PD-1 comprises (i) the sequence of amino acids set forth in SEQ ID NO: 244, (ii) a sequence of amino acids that has at least 95% sequence identity to SEQ ID NO: 244, (ii) a sequence of amino acids that has at least 95% sequence identity to SEQ ID NO: 244, or (iii) is a portion of (i) or (ii) comprising an IgV domain or specific binding fragment thereof.

Provided herein are polynucleotides comprising a sequence of nucleotides encoding any of the described transmembrane immunomodulatory proteins. In some embodiments, the polynucleotide further comprises a sequence of nucleotides encoding a recombinant receptor. In some embodiments, the recombinant receptor specifically binds to an antigen. In some embodiments, the antigen is associated with a disease or condition. In some embodiments, the antigen is a tumor antigen or a viral antigen. In some embodiments, the recombinant receptor is a chimeric antigen receptor. In some embodiments, the recombinant receptor is a T cell receptor. In some embodiments, the T cell receptor is specific for an HPV antigen, optionally an HPV16 E6 or HPV16 E7. In some embodiments, the sequence of nucleotides encoding the TIP and the sequence of nucleotides encoding the recombinant receptor are separated by a self-cleaving peptide or ribosome skip element, optionally T2A or P2A. Further provided herein are vectors comprising any of the described polynucleotides. In some embodiments, the vector is a viral vector, optionally a lentiviral vector.

Provided herein are engineered cells comprising any of the described TIPS, a polynucleotide encoding a TIP, or a vector comprising a polynucleotide encoding a TIP. Also provided herein are engineered cells containing any of the variant PD-1 polypeptides, immunomodulatory proteins, conjugates that is any of the provided fusion proteins, nucleic acid molecules or vectors. In some embodiments, the protein containing a variant PD-1 polypeptide is capable of being secreted from the engineered cell. In some embodiments, the protein does not contain a cytoplasmic signaling domain or transmembrane domain and/or is not expressed on the surface of the cell; and/or the protein is capable of being secreted from the engineered cell when expressed.

In some cases, the cell is an immune cell. In some instances, the immune cell is a lymphocyte. In some examples, the lymphocyte is a T cell. In some embodiments, the T cell is a CD4+ and/or CD8+ T cell. In some embodiments, the T cell is a regulatory T cell (Treg). In some embodiments, the engineered cell is a primary cell. In some cases, the cell is a mammalian cell. In some embodiments, the cell is a human cell. In some embodiments, the engineered cell further contains a chimeric antigen receptor (CAR). In some cases, the engineered cell further contains an engineered T-cell receptor (TCR).

Provided herein are infectious agents containing any of the provided variant PD-L1 polypeptides, immunomodulatory proteins, TIPs, conjugates that is any of the provided fusion proteins, nucleic acid molecules or vectors. In some embodiments, the infectious agent is a bacterium or a virus. In some cases, the infectious agent is a virus and the virus is an oncolytic virus.

Also provided herein are pharmaceutical compositions including any of the provided variant PD-L1 polypeptides, immunomodulatory proteins, TIPs, conjugates that is any of the provided fusion proteins, engineered cells or infectious agents. In some embodiments, the pharmaceutical composition includes a pharmaceutically acceptable excipient. In some examples, the pharmaceutical composition is sterile.

Provided herein are articles of manufacture containing any of the provided pharmaceutical compositions in a vial or a container. In some embodiments, the vial or container is sealed.

Provided herein are kits containing any of the provided pharmaceutical compositions or articles of manufacture and instructions for use.

Provided are methods of modulating an immune response in a subject, the method including administering any of the variant PD-L1 polypeptides, immunomodulatory proteins, TIPs, conjugates that is any of the provided fusion proteins, engineered cells or infectious agents or the pharmaceutical compositions. In some embodiments, the method includes administering any of the provided immunomodulatory proteins to the subject. In some cases, the method includes administering any of the provided immunomodulatory proteins to the subject.

Provided herein are methods of modulating an immune response in a subject including administering any of the provided engineered cells. In some embodiments, the engineered cells are autologous to the subject. In some embodiments, modulating the immune response treats a disease or condition in the subject. In some embodiments, the immune response is increased.

Provided herein are methods of mediating CD28 agonism by PD-L1-dependent CD28 costimulation, containing administering any of the provided immunomodulatory proteins. In some embodiments, the method is for use in treating a disease or condition. In some embodiments, prior to the administering, selecting a subject for treatment that has a tumor including cells positive for surface PD-L1, optionally wherein the cells are tumor cells or tumor infiltrating immune cells; or the subject has been selected as having a tumor including cells surface positive for PD-L1, optionally wherein the cells are tumor cells or tumor infiltrating immune cells. In some embodiments, selecting a subject includes contacting a tumor tissue sample from a subject with a binding reagent capable of specifically binding the ectodomain of PD-L1; detecting the presence of the bound binding reagent in or on cells of the tumor tissue sample, optionally wherein the cells are tumor cells or tumor infiltrating immune cells; and if the tumor tissue sample includes a detectable level of cells surface positive for PD-L1, selecting the subject for treatment.

In some embodiments, prior to the administering, selecting a subject for treatment that has a tumor including cells surface positive for CD28, optionally wherein the cells are tumor infiltrating lymphocytes, optionally wherein the lymphocytes are T cells, optionally CD8+ T cells; or the subject has been selected as having a tumor including cells surface positive for CD28, optionally wherein the cells are tumor infiltrating lymphocytes, optionally wherein the lymphocytes are T cells, optionally CD8+ T cells. In some examples, selecting the subject includes contacting a tumor tissue sample from a subject with a binding reagent capable of specifically binding the ectodomain of CD28; detecting the presence of the bound binding reagent in or on cells of the tumor tissue sample, optionally wherein the cells are tumor infiltrating lymphocytes, optionally wherein the lymphocytes are T cells, optionally CD8+ T cells; and if the tumor tissue sample includes a detectable level of cells surface positive for CD28, selecting the subject for treatment.

In some embodiments, the tumor tissue sample contains tumor infiltrating immune cells, tumor cells, stromal cells, or any combination thereof. In some embodiments, the binding reagent is an antibody or antigen-binding fragment, protein ligand or binding partner, an aptamer, an affimer, a peptide or a hapten. In some embodiments, the binding reagent is an anti-PD-L1 antibody or antigen-binding fragment. In some cases, the disease or condition is a tumor or cancer. In some embodiments, the subject has relapsed following remission, has become refractory, or is a non-responder, after treatment with an antagonist of PD-1/PD-L1 or PD-1/PD-L2. In some examples, the antagonist is an anti-PD-1 antibody, optionally nivolumab or pembrolizumab.

BRIEF DESCRIPTION OF THE DRAWINGS

FIG. 1A depicts soluble molecules, including: (1) a variant IgSF domain (vIgD) fused to an Fc chain; (2) a stack molecule containing a first variant IgSF domain (first vIgD) and a second IgSF domain, such as a second variant IgSF domain (second vIgD); (3) a tumor targeting IgSF molecule containing a first variant IgSF domain (vIgD) and an IgSF domain that targets to a tumor antigen, such as an NKp30 IgSF domain; and (4) a variant IgSF domain (vIgD) linked to an antibody (V-mAb). FIG. 1B depicts a transmembrane immunomodulatory protein (TIP) containing a variant IgSF domain (vIgD) expressed on the surface of a cell. In an exemplary embodiment, the cognate binding partner of the transmembrane bound vIgD is an inhibitory ligand (e.g. PD-L1), and the TIP containing the vIgD (e.g. PD-1 vIgD) can act as a decoy counter-structure to inhibit specific binding by and between PD-1 and PD-L1. The PD-1 TIP may or may not contain activating intracellular ITAM motifs to provide further activation signals for the engineered T cell. FIG. 1C depicts a secreted immunomodulatory protein (SIP) in which a variant IgSF domain (vIgD) is secreted from a cell, such as a T cell (e.g. CAR T cell). In an exemplary embodiment, the cognate binding partner of the secreted vIgD is an inhibitory ligand (e.g., PD-L1), which can be expressed by the another cell, such as another T cell, tumor cell or antigen presenting cell (APC)). Upon binding of the SIP with its cognate binding partner, the SIP antagonizes or blocks the negative signaling via the inhibitory ligand, thereby resulting in an activated T cell or effector T cell. In all cases, the vIgD can include the extracellular domain or a portion thereof containing the IgV domain or a specific binding fragment thereof.

FIG. 5 depicts an exemplary alignment of the wildtype PD-1 sequence set forth in SEQ ID NO:37 containing residues 1-150 of the PD-1 designated "PD-1 (1-150)" with a wildtype PD-1 sequence set forth in SEQ ID NO: 392 containing residues 6-127 of the PD-1 designated "PD-1 (6-127)". The symbol "1" between two aligned residues indicates that the aligned amino acids are identical. The absence of a "1" between two aligned residues indicates that the aligned amino acids are not identical. The symbol "-" indicates a gap in the alignment. Exemplary, non-limiting positions in SEQ ID NO:392 corresponding to positions with numbering set forth in SEQ ID NO:37 are indicated by a box.

FIG. 7B depicts TNFα (left) or IFN-gamma (IFNγ) (right) release in supernatant 24 hours after co-culture of Caski target cells and E6 TCR-engineered T cells expressing a TCR alone or co-expressing an indicated PD-1 switch-TIP. Reference to the SEQ ID NO (ID) of the PD-1 TIP is indicated.

FIG. 8 depicts an exemplary alignment of the wildtype CD86 extracellular domain (ECD) sequence set forth in SEQ ID NO: 29 containing residues 24-247 of the CD86 designated "CD86(B7-2)" (SEQ ID NO: 2) with the wildtype IgV sequence set forth in SEQ ID NO: 1104 containing residues 33-131 of the CD86 designated "CD86(B7-2)" (SEQ ID NO: 2). The symbol "*" indicates that the two aligned residues are identical. The absence of a "*" between two aligned residues indicates that the aligned amino acids are not identical. The symbol "-" indicates a gap in the alignment. Exemplary, non-limiting positions in SEQ ID NO: 1104 corresponding to positions with numbering set forth in SEQ ID NO: 29 are indicated by a box.

FIG. 9A and FIG. 9B depict binding of exemplary PD1-CD86 stack constructs at various concentrations (0.1 nM to 100 nM) to cognate binding partner CTLA-4, determined by mean Fluorescence Intensity (MFI) assessed by flow cytometry.

DETAILED DESCRIPTION

Figure 1A:
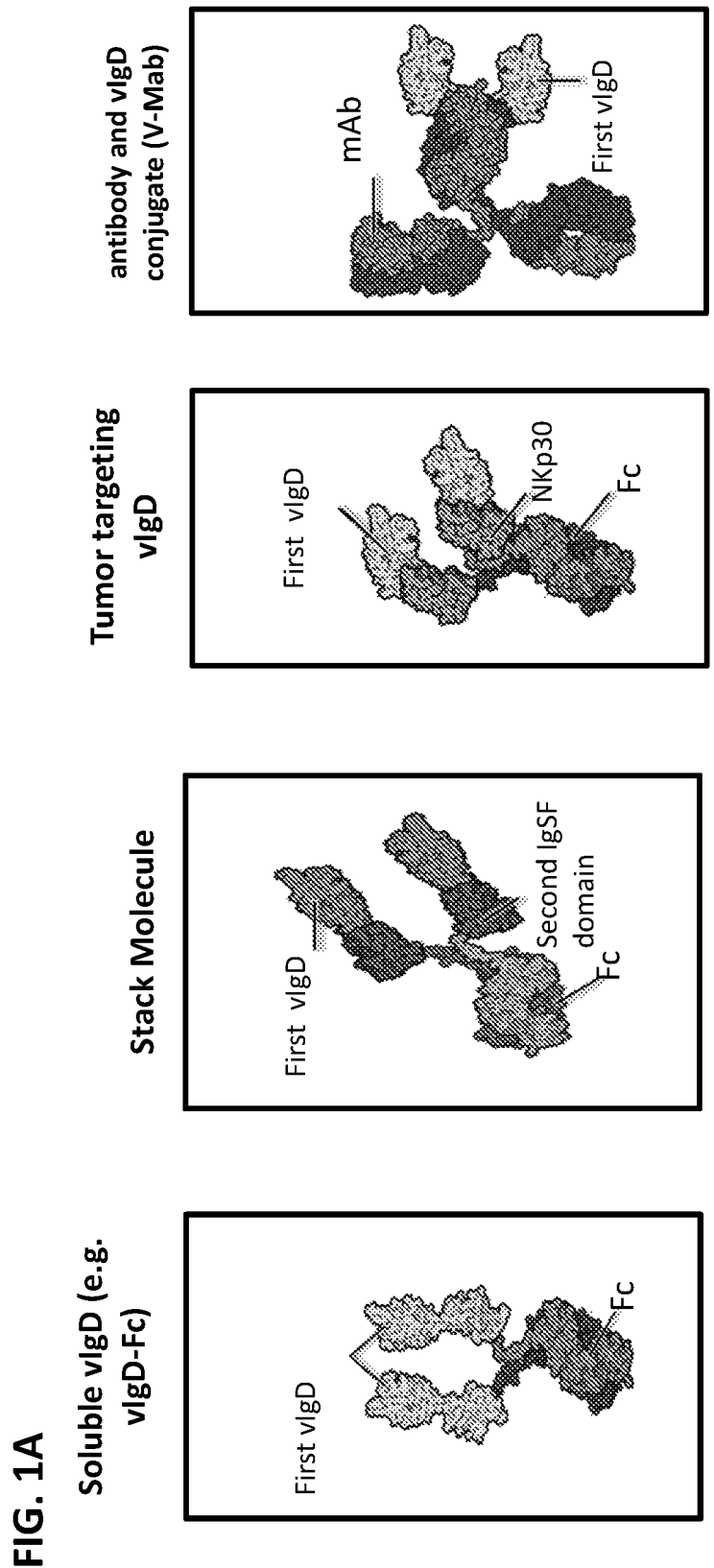
FIG. 1A-1C depicts various formats of the provided variant IgSF domain molecules.
Figure 1B:
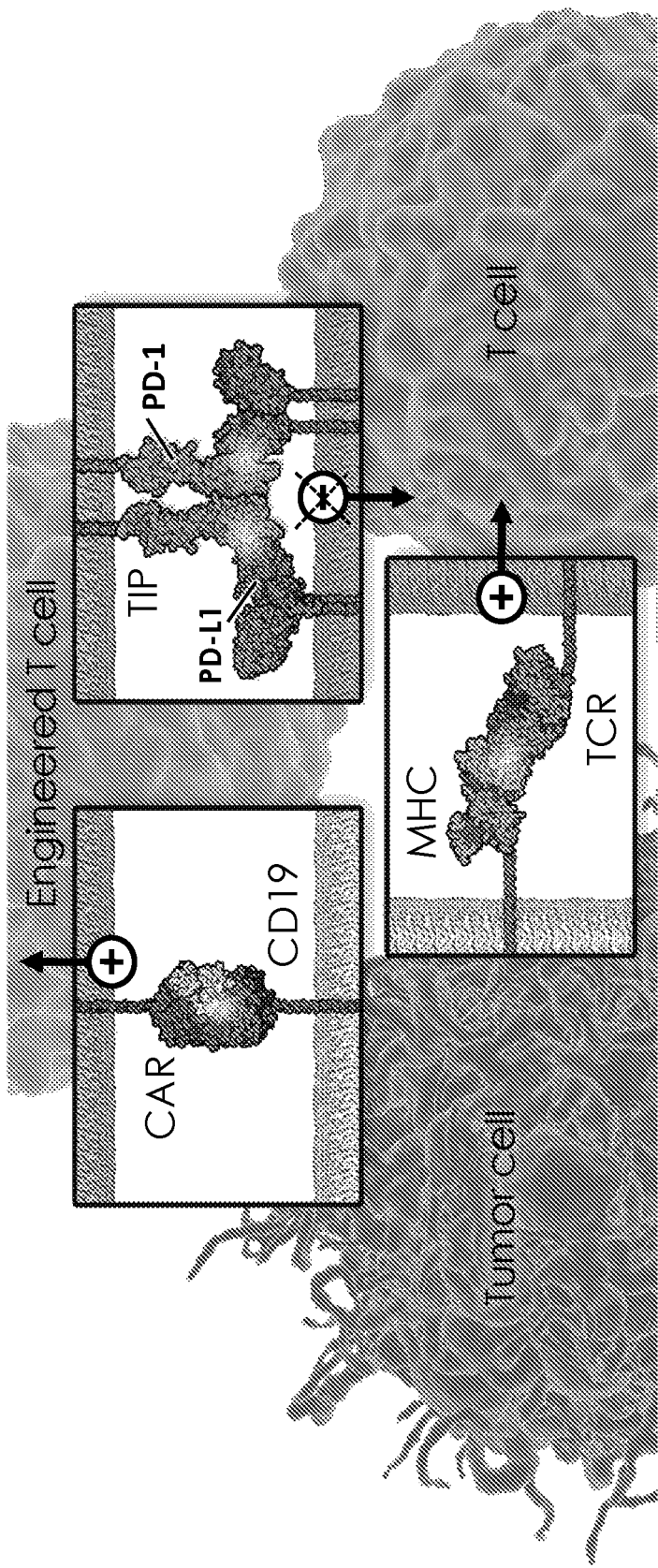
Figure 1C:
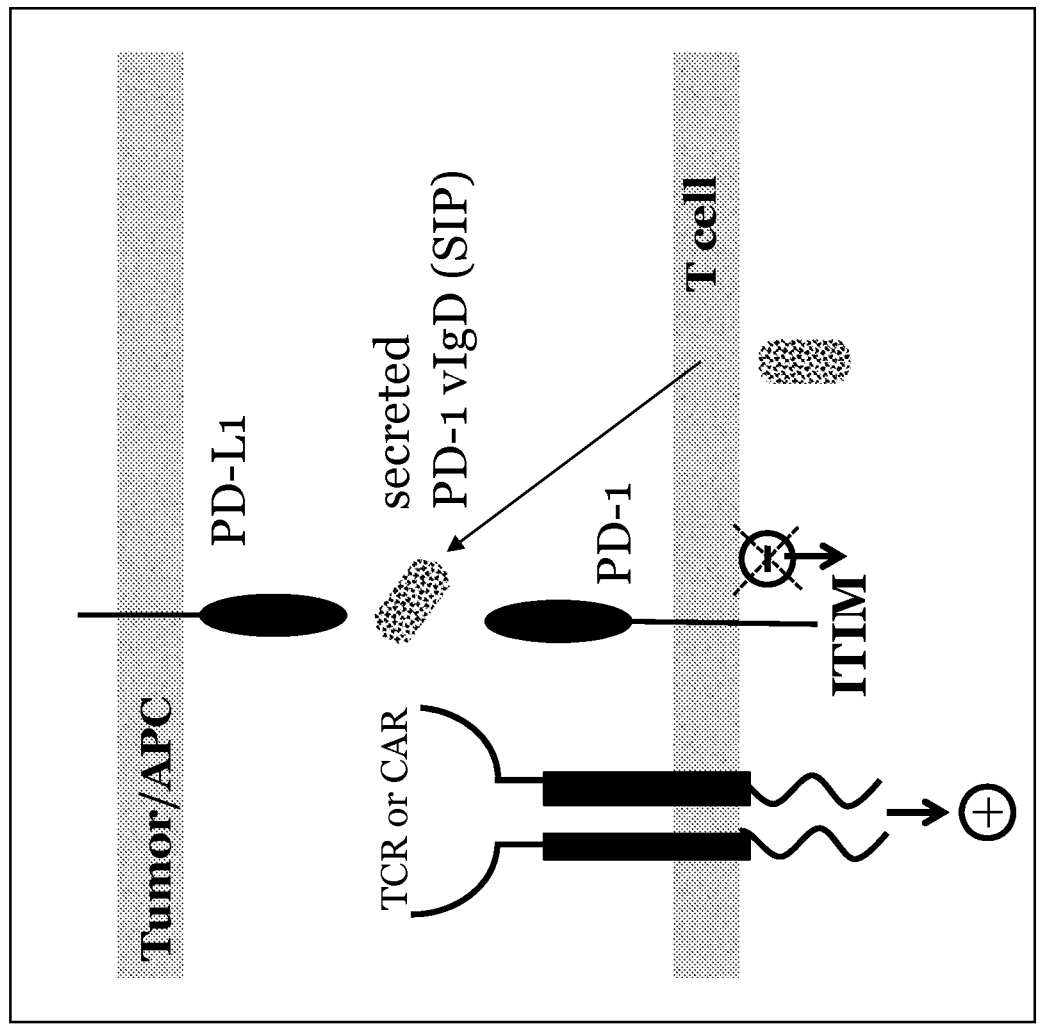
Figure 2:
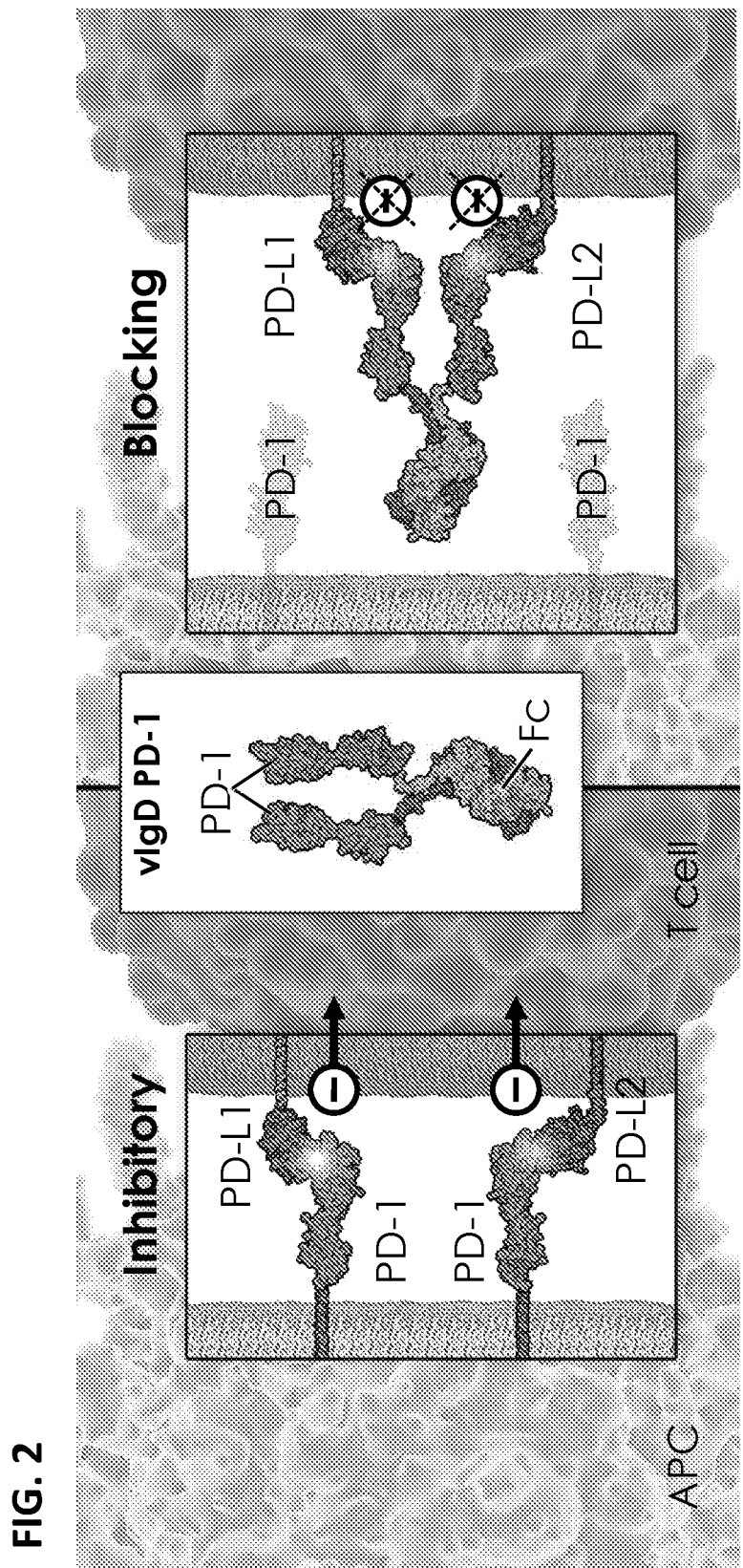
FIG. 2 depicts an exemplary schematic of the activity of a variant IgSF domain (vIgD) fused to an Fc (vIgD-Fc) in which the vIgD is a variant of an IgSF domain of PD-1. As shown, a soluble vIgD of PD-1 interacts with its cognate binding partners (e.g. PD-L1) to block interactions with PD-1, thereby blocking the PD-1 inhibitory receptor, and, in some cases, allowing the T cell to differentiate into an effector phenotype.

Provided herein are immunomodulatory proteins that are or comprise variants or mutants of Programmed cell Death protein 1 PD-1 (also known as PDCD1, cluster of differentiation 279, CD279, SLEB2, hPD-1, or hSLE1) or specific binding fragments thereof that exhibit activity to bind to at least one target ligand cognate binding partner (also called counter-structure protein). In some embodiments, the variant PD-1 polypeptides contain one or more amino acid modifications (e.g. amino acid substitutions, deletions or additions) compared to an unmodified or wild-type PD-1 polypeptide. In some embodiments, the one or more amino acid modifications (e.g. substitutions) are in an IgSF domain (e.g. IgV) of an unmodified or wild-type PD-1 polypeptide. In some embodiments, the variant PD-1 polypeptide and immunomodulatory proteins exhibits altered, such as increased or decreased, binding activity or affinity for at least one cognate binding partner, such as at least one of PD-L1.

In some embodiments, the altered binding activity, such as binding affinity, e.g., increased or decreased binding affinity, is for at least one binding partner protein PD-L1 or PD-L2. In some embodiments, the variant PD-1 polypeptides exhibit altered, such as increased or decreased, binding affinity to one or more of PD-L1 or PD-L2 compared to the unmodified or wild-type PD-1 not containing the one or more modifications. In some embodiments, the variant PD-1 polypeptides exhibit increased binding affinity to PD-L1 compared to the unmodified or wild-type PD-1 not containing the one or more modifications. In some embodiments, the variant PD-1 polypeptides exhibit decreased binding affinity to PD-L2 compared to the unmodified or wild-type PD-1 not containing the one or more modifications. In some embodiments, the variant PD-1 polypeptides exhibit increased binding affinity to PD-L1, and decreased binding affinity to PD-L2 compared to the unmodified or wild-type PD-1 not containing the one or more modifications.

In some embodiments, the variant PD-1 polypeptides provided herein exhibit increased selectivity for binding to PD-L1 versus PD-L2 compared to the selectivity of the unmodified or wild-type PD-1 not containing the one more modifications for binding to PD-L1 versus PD-L2. The increased selectivity can be characterized as a greater ratio of binding, e.g., binding affinity, of the variant PD-1 polypeptide for PD-L1 versus PD-L2 compared to the ratio of binding, e.g., binding affinity, of the unmodified or wild-type PD-1 for binding of PD-L1 versus PD-L2. In some embodiments, the ratio is increased greater than or greater than about 1.2-fold, 1.5-fold, 2.0-fold, 3.0-fold, 4.0-fold, 5.0-fold, 6.0-fold, 7.0-fold, 8.0-fold, 9.0-fold, 10.0-fold, 15.0-fold, 20-fold, 30-fold, 40-fold, 50-fold, 100-fold or more.

Also provided are various formats of the provided variant polypeptides and immunomodulatory proteins. As shown herein, alternative formats can facilitate manipulation of the immune response, and hence the therapeutic application. The ability to format the variant polypeptides in various configurations offers flexibility in therapeutic applications based on the same increased binding and activity of a variant PD-1 for binding partners. In some embodiments, the immunomodulatory proteins are soluble. In some embodiments, the immunomodulatory proteins are transmembrane immunomodulatory proteins capable of being expressed on the surface of cells. In some embodiments, the immunomodulatory proteins are secretable immunomodulatory proteins capable of being secreted from a cell in which it is expressed. In some aspects, provided are engineered cells containing the transmembrane immunomodulatory proteins or secretable immunomodulatory proteins. In some aspects, provided are infectious agents capable of delivering for expression the transmembrane immunomodulatory proteins or secretable immunomodulatory proteins into a cell in which the infectious agent infects. In some embodiments, also provided herein are one or more other immunomodulatory proteins that are conjugates or fusions containing a variant PD-1 polypeptide provided herein and one or more other moiety or polypeptide.

In some embodiments, the variant PD-1 polypeptides and immunomodulatory proteins modulate an immunological immune response, such an increased immune response. In some embodiments, the variant PD-1 polypeptides and immunomodulatory proteins provided herein can be used for the treatment of diseases or conditions that are associated with a dysregulated immune response, such as in connection with oncology indications, including for the treatment of tumors or cancers.

In some embodiments, the provided variant PD-1 polypeptides modulate T cell activation via interactions with a counter-structure expressed on one or more immune cells. In general, antigen specific T-cell activation generally requires two distinct signals. The first signal is provided by the interaction of the T-cell receptor (TCR) with major histocompatibility complex (MHC) associated antigens present on antigen presenting cells (APCs). The second signal is costimulatory, e.g., a CD28 costimulatory signal, to TCR engagement and is necessary for T cell proliferation, differentiation and/or survival, including, in some cases, to avoid T-cell apoptosis or anergy. In some embodiments, under normal physiological conditions, the T cell-mediated immune response is initiated by antigen recognition by the T cell receptor (TCR) and is regulated by a balance of co-stimulatory and inhibitory signals (e.g., immune checkpoint proteins). The immune system relies on immune checkpoints to prevent autoimmunity (i.e., self-tolerance) and to protect tissues from excessive damage during an immune response, for example during an attack against a pathogenic infection. In some cases, however, these immunomodulatory proteins can be dysregulated in diseases and conditions, including tumors, as a mechanism for evading the immune system.

In some embodiments, among known T-cell inhibitory receptors is Programmed cell death protein 1 or PD-1, which is the T-cell inhibitor receptor for the ligands PD-L1 (also known as cluster of differentiation 274, CD274. B7 homolog 1 or B7-H1) and Programmed cell death 1 ligand 2 or PD-L2 (also known as PDCD1L2, PDCD1LG2, cluster of differentiation 273, CD273. or B7-DC). PD-L1 and PD-L2 are normally expressed on the surface of T cells, B cells, and myeloid cells. PD-L1 and PD-L2 are negative regulators of immune activation and are capable of down-modulating the immune response via interactions with programmed death 1 (PD-1) receptor. In some aspects, PD-1 is expressed on NK cells and T cells, including CD4+ and CD8+ T cells, whereby engagement of PD-1 can inhibit activation cell activation, proliferation, and/or expansion. In some embodiments, enhancement or suppression of the activity of PD-1 receptor has clinical significance for treatment of inflammatory and autoimmune disorders, cancer, and viral infections. In some cases, however, therapies to intervene and alter the immunomodulatory effects of such receptors are constrained by the spatial orientation requirements as well as size limitations imposed by the confines of the immunological synapse. In some aspects, existing therapeutic drugs, including antibody drugs, may not be able to interact simultaneously with the multiple target proteins involved in modulating these interactions. In addition, in some cases, existing therapeutic drugs may only have the ability to antagonize but not agonize an immune response. Additionally, pharmacokinetic differences between drugs that independently target one of these receptors can create difficulties in properly maintaining a desired blood concentration of such drug combinations throughout the course of treatment.

In some embodiments, the provided variant PD-1 polypeptides or immunomodulatory proteins modulate (e.g. increase or decrease) the immunological activity associated with the PD-L1/PD-1 negative regulatory complex. Thus, in some embodiments, the provided polypeptides overcome these constraints by providing variant PD-1 with altered (e.g. increased or decreased) binding affinities to PD-L1, thereby modulating the effects of the interaction between PD-1 and PD-L2. Methods of making and using these variant PD-1 are also provided.

Figure 3:
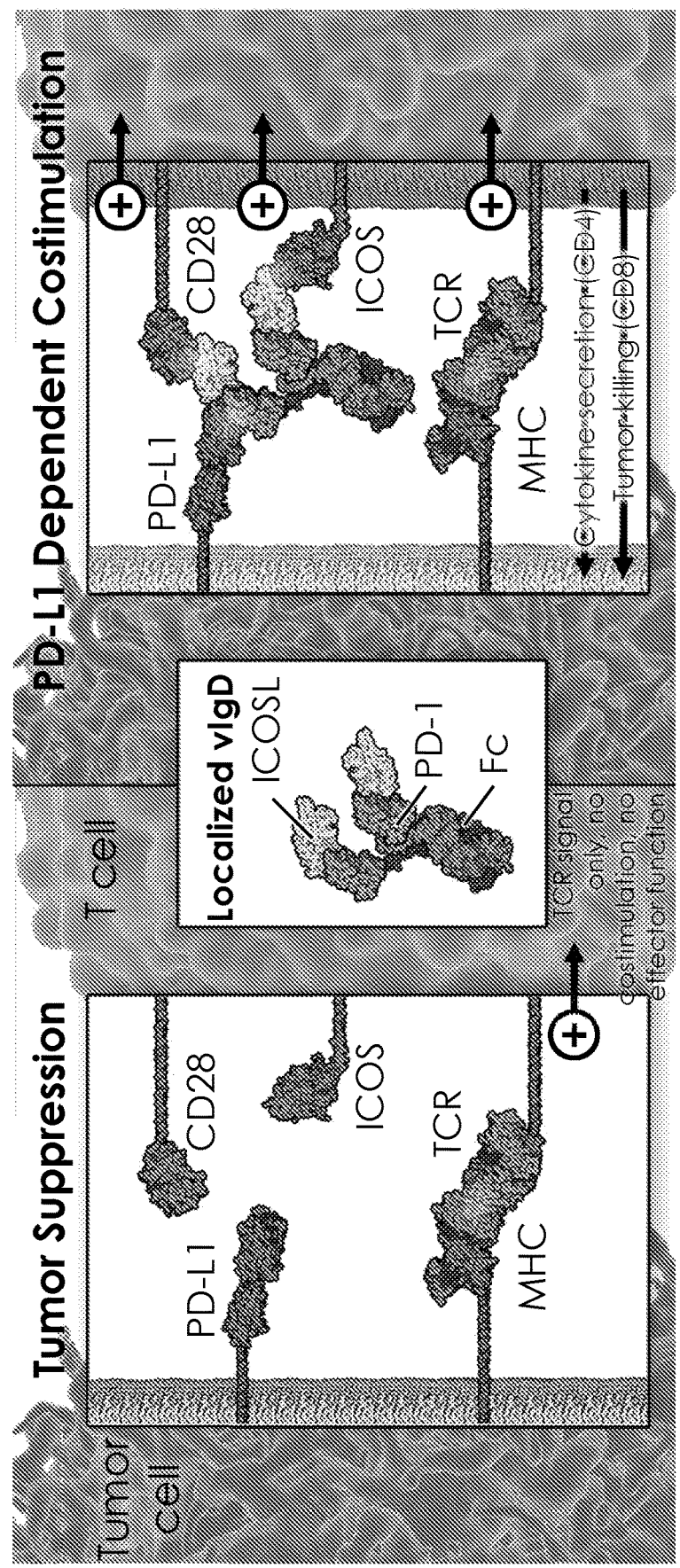
FIG. 3 depicts an exemplary schematic of the activity of a variant PD-1 IgSF domain (vIgD)conjugated to an Fc in which the PD-1-Fc induces PD-L1-dependent CD28 agonist activity. In the exemplary schematic, the second IgSF domain (e.g. second vIgD) is a CD28-binding polypeptide, such as a ICOSL vIgD. Similar constructs are contemplated with other CD28-binding polypeptides (e.g. CD86 vIgD). As shown, binding of the variant PD-1 to PD-L1, expressed on the surface of a tumor cell, can prevent the association of the PD-L1 on the tumor cell and the inhibitory PD-1 receptor, expressed on the surface of a T cell. In addition, the CD28-binding polypeptide, e.g. ICOSL vIgD, is available to bind the costimulatory CD28 receptor on the surfaces of a T cell, thereby localizing the T cell to the tumor while promoting T cell activation via CD28 costimulation of TCR signal.

In some embodiments, the provided PD-1 polypeptides and immunomodulatory proteins, e.g., soluble or secretable forms provided herein, are capable of binding the PD-L1 on a tumor cell or APC, thereby blocking the interaction of PD-L1 and the PD-1 inhibitory receptor and, in some aspects, preventing the negative regulatory signaling that would have otherwise resulted from the PD-L1/PD-1 interaction. In some embodiments, provided variant PD-1 immunomodulatory proteins further contain a CD28-binding molecule, e.g. ICOSL or CD86 wildtype or variant IgD. In some aspects, such immunomodulatory proteins, e.g., soluble forms thereof provided herein, can block the PD-L1/PD-1 interaction while, binding and co-stimulating a CD28 receptor on a localized T cell, thereby promoting an immune response (FIG. 3).

Thus, in some aspects, provided herein are methods and uses to mediate CD28 agonism. In some cases, CD28 agonism is mediated by certain immunomodulatory proteins provided as a "stack" molecule containing a variant PD-1 polypeptide and a CD28-binding molecule, e.g. a molecule containing an IgSF domain of ICOSL, CD80 or CD86 or a variant thereof with increased binding affinity for CD28. The molecules can be formatted with a multimerization domain, such as an Fc domain, which provides a convenient and efficient soluble format for therapeutic applications. Such provided immunomodulatory proteins exhibit increased binding to PD-L1 to thereby facilitate tethering or cross-linking of the variant PD-1 molecule to a surface at the immune synapse for interaction of the CD28-binding molecule with CD28, thereby facilitating T cell activation by providing a costimulatory signal (designated herein as PD-L1-dependent CD28 costimulation). In some cases, such PD-L1-dependent costimulation does not require an Fc with effector function and can be mediated by an Fc fusion protein containing an effector-less or inert Fc molecule.

In some embodiments, the provided variant PD-1 polypeptides can be engineered for expression as a transmembrane immunomodulatory protein (TIP) on an immune cell, such as a T cell. Among such TIP formats provided herein are switch-TIPs in which the inhibitory intracellular signaling domain is replaced with one or more activating and/or costimulatory intracellular signaling domain, thereby "switching" an inhibitory response to a positive response. In some aspects, binding of a variant PD-1 of an extracellular domain of a switch-TIP to PD-L1 can activate, potentiate, enhance or increase an immune response in a cell in which it is expressed. In some embodiments, a variant switch-TIP can be co-expressed or engineered into a cell that expresses a recombinant receptor, such as a chimeric antigen receptor (CAR) or T cell receptor (TCR), and can potentiate, enhance or increase immune responses of such engineered cell compared to an engineered cell that only expresses the recombinant receptor. In particular, as shown herein, variant PD-1 switch-TIPs containing one or more various costimulatory signaling domains potently enhance activity of TCR-engineered immune cells.

The provided variant PD-1 switch-TIP-expressing cells, e.g. T cells, can be used in adoptive cell therapy methods, such as TCR-based or CAR-based cell therapies. TCR-engineered T cell therapies are being developed as a personalized adoptive anticancer treatment. In some cases, however, clinical experience has demonstrated only modest efficacy which may be due, in part, to unfavorable factors in the tumor microenvironment. This includes the presence of receptors, such as PD-L1, that can inhibit T cell responses, and/or insufficient engineered T cell longevity. In some aspects strategies to address such limitations have involved attempts to provide additional costimulatory signals to T cells. However, addition of costimulatory signals alone may not be sufficient to overcome PD-L1-mediated inhibition. In some aspects, the provided PD-1 switch-TIPs overcome these limitations by their potential to both block the PD-L1/PD-1 interaction while inducing costimulation in cells in which they are expressed. As observed herein, such variant PD-1 switch-TIPs containing a checkpoint-inhibitory PD-1 variant extracellular domain and an intracellular costimulatory signaling domain potently augment the antitumor activity of TCR-engineered T cells as judged by proliferation, cytokine production and cytotoxicity. In some aspects, the provided variant PD-1 switch-TIPs may therefore improve the activity of TCR-engineered T cells by providing costimulation while preventing inhibitory signaling through native PD-1.

All publications, including patents, patent applications scientific articles and databases, mentioned in this specification are herein incorporated by reference in their entirety for all purposes to the same extent as if each individual publication, including patent, patent application, scientific article or database, were specifically and individually indicated to be incorporated by reference. If a definition set forth herein is contrary to or otherwise inconsistent with a definition set forth in the patents, applications, published applications and other publications that are herein incorporated by reference, the definition set forth herein prevails over the definition that is incorporated herein by reference.

The section headings used herein are for organizational purposes only and are not to be construed as limiting the subject matter described.

I. DEFINITIONS

Unless defined otherwise, all terms of art, notations and other technical and scientific terms or terminology used herein are intended to have the same meaning as is commonly understood by one of ordinary skill in the art to which the claimed subject matter pertains. In some cases, terms with commonly understood meanings are defined herein for clarity and/or for ready reference, and the inclusion of such definitions herein should not necessarily be construed to represent a substantial difference over what is generally understood in the art.

The terms used throughout this specification are defined as follows unless otherwise limited in specific instances. As used in the specification and the appended claims, the singular forms "a," "an," and "the" include plural referents unless the context clearly dictates otherwise. Unless defined otherwise, all technical and scientific terms, acronyms, and abbreviations used herein have the same meaning as commonly understood by one of ordinary skill in the art to which the invention pertains. Unless indicated otherwise, abbreviations and symbols for chemical and biochemical names is per IUPAC-IUB nomenclature. Unless indicated otherwise, all numerical ranges are inclusive of the values defining the range as well as all integer values in-between.

The term "affinity modified" as used in the context of an immunoglobulin superfamily domain, means a mammalian immunoglobulin superfamily (IgSF) domain having an altered amino acid sequence (relative to the corresponding wild-type parental or unmodified IgSF domain) such that it has an increased or decreased binding affinity or avidity to at least one of its cognate binding partners (alternatively "counter-structures") compared to the parental wild-type or unmodified (i.e., non-affinity modified) IgSF control domain. Included in this context is an affinity modified PD-1 IgSF domain. In some embodiments, the affinity-modified IgSF domain can contain 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more amino acid differences, such as amino acid substitutions, in a wildtype or unmodified IgSF domain. An increase or decrease in binding affinity or avidity can be determined using well known binding assays such as flow cytometry. Larsen et al., American Journal of Transplantation, Vol 5: 443-453 (2005). See also, Linsley et al., Immunity, Vol 1(9): 793-801 (1994). An increase in a protein's binding affinity or avidity to its cognate binding partner(s) is to a value at least 10% greater than that of the wild-type IgSF domain control and in some embodiments, at least 20%, 30%, 40%, 50%, 100%, 200%, 300%, 500%, 1000%, 5000%, or 10000% greater than that of the wild-type IgSF domain control value. A decrease in a protein's binding affinity or avidity to at least one of its cognate binding partner is to a value no greater than 90% of the control but no less than 10% of the wild-type IgSF domain control value, and in some embodiments no greater than 80%, 70% 60%, 50%, 40%, 30%, or 20% but no less than 10% of the wild-type IgSF domain control value. An affinity-modified protein is altered in primary amino acid sequence by substitution, addition, or deletion of amino acid residues. The term "affinity modified IgSF domain" is not to be construed as imposing any condition for any particular starting composition or method by which the affinity-modified IgSF domain was created. Thus, the affinity modified IgSF domains of the present invention are not limited to wild type IgSF domains that are then transformed to an affinity modified IgSF domain by any particular process of affinity modification. An affinity modified IgSF domain polypeptide can, for example, be generated starting from wild type mammalian IgSF domain sequence information, then modeled in silico for binding to its cognate binding partner, and finally recombinantly or chemically synthesized to yield the affinity modified IgSF domain composition of matter. In but one alternative example, an affinity modified IgSF domain can be created by site-directed mutagenesis of a wild-type IgSF domain. Thus, affinity modified IgSF domain denotes a product and not necessarily a product produced by any given process. A variety of techniques including recombinant methods, chemical synthesis, or combinations thereof, may be employed.

The term "allogeneic" as used herein means a cell or tissue that is removed from one organism and then infused or adoptively transferred into a genetically dissimilar organism of the same species. In some embodiments of the invention, the species is murine or human.

The term "autologous" as used herein means a cell or tissue that is removed from the same organism to which it is later infused or adoptively transferred. An autologous cell or tissue can be altered by, for example, recombinant DNA methodologies, such that it is no longer genetically identical to the native cell or native tissue which is removed from the organism. For example, a native autologous T-cell can be genetically engineered by recombinant DNA techniques to become an autologous engineered cell expressing a transmembrane immunomodulatory protein and/or chimeric antigen receptor (CAR), which in some cases involves engineering a T-cell or TIL (tumor infiltrating lymphocyte). The engineered cells are then infused into a patient from which the native T-cell was isolated. In some embodiments, the organism is human or murine.

The terms "binding affinity," and "binding avidity" as used herein means the specific binding affinity and specific binding avidity, respectively, of a protein for its counter-structure under specific binding conditions. In biochemical kinetics avidity refers to the accumulated strength of multiple affinities of individual non-covalent binding interactions, such as between PD-1 and its counter-structures PD-L1 and/or PD-L2. As such, avidity is distinct from affinity, which describes the strength of a single interaction. An increase or attenuation in binding affinity of a variant PD-1 containing an affinity modified PD-1 IgSF domain to its counter-structure is determined relative to the binding affinity of the unmodified PD-1, such as an unmodified PD-1 containing the native or wild-type IgSF domain, such as IgV domain. Methods for determining binding affinity or avidity are known in art. See, for example, Larsen et al., American Journal of Transplantation, Vol 5: 443-453 (2005). In some embodiments, a variant PD-1 of the invention (i.e. a PD-1 protein containing an affinity modified IgSF domain) specifically binds to PD-L1 and/or PD-L2 measured by flow cytometry with a binding affinity that yields a Mean Fluorescence Intensity (MFI) value at least 10%, 20%, 30%, 40%, 50%, 60%, 70%, 80%, 90%, or 100% greater than a wild-type PD-1 control in a binding assay.

The term "biological half-life" refers to the amount of time it takes for a substance, such as an immunomodulatory polypeptide comprising a variant PD-1 of the present invention, to lose half of its pharmacologic or physiologic activity or concentration. Biological half-life can be affected by elimination, excretion, degradation (e.g., enzymatic) of the substance, or absorption and concentration in certain organs or tissues of the body. In some embodiments, biological half-life can be assessed by determining the time it takes for the blood plasma concentration of the substance to reach half its steady state level ("plasma half-life"). Conjugates that can be used to derivatize and increase the biological half-life of polypeptides of the invention are known in the art and include, but are not limited to, polyethylene glycol (PEG), hydroxyethyl starch (HES), XTEN (extended recombinant peptides; see, WO2013130683), human serum albumin (HSA), bovine serum albumin (BSA), lipids (acylation), and poly-Pro-Ala-Ser (PAS), polyglutamic acid (glutamylation).

The term "chimeric antigen receptor" or "CAR" as used herein refers to an artificial (i.e., man-made) transmembrane protein expressed on a mammalian cell comprising at least an ectodomain, a transmembrane, and an endodomain. Optionally, the CAR protein includes a "spacer" which covalently links the ectodomain to the transmembrane domain. A spacer is often a polypeptide linking the ectodomain to the transmembrane domain via peptide bonds. The CAR is typically expressed on a mammalian lymphocyte. In some embodiments, the CAR is expressed on a mammalian cell such as a T-cell or a tumor infiltrating lymphocyte (TIL). A CAR expressed on a T-cell is referred to herein as a "CAR T-cell" or "CAR-T." In some embodiments the CAR-T is a T helper cell, a cytotoxic T-cell, a natural killer T-cell, a memory T-cell, a regulatory T-cell, or a gamma delta T-cell. When used clinically in, e.g. adoptive cell transfer, a CAR-T with antigen binding specificity to the patient's tumor is typically engineered to express on a T-cell obtained from the patient. The engineered T-cell expressing the CAR is then infused back into the patient. The CAR-T is thus often an autologous CAR-T although allogeneic CAR-T are included within the scope of the invention. The ectodomain of a CAR comprises an antigen binding region, such as an antibody or antigen binding fragment thereof (e.g. scFv), that specifically binds under physiological conditions with a target antigen, such as a tumor specific antigen. Upon specific binding a biochemical chain of events (i.e., signal transduction) results in modulation of the immunological activity of the CAR-T. Thus, for example, upon specific binding by the antigen binding region of the CAR-T to its target antigen can lead to changes in the immunological activity of the T-cell activity as reflected by changes in cytotoxicity, proliferation or cytokine production. Signal transduction upon CAR-T activation is achieved in some embodiments by the CD3-zeta chain ("CD3-z") which is involved in signal transduction in native mammalian T-cells. CAR-Ts can further comprises multiple signaling domains such as CD28, 41BB or OX40, to further modulate immunomodulatory response of the T-cell. CD3-z comprises a conserved motif known as an immunoreceptor tyrosine-based activation motif (ITAM) which is involved in T-cell receptor signal transduction.

The term "collectively" or "collective" when used in reference to cytokine production induced by the presence of two or more variant PD-1 of the invention in an in vitro assay, means the overall cytokine expression level irrespective of the cytokine production induced by individual variant PD-1. In some embodiments, the cytokine being assayed is IFN-gamma, such as in an in vitro primary T-cell assay.

The term "cognate binding partner" (used interchangeably with "counter-structure") in reference to a polypeptide, such as in reference to an IgSF domain of a variant PD-1, refers to at least one molecule (typically a native mammalian protein) to which the referenced polypeptide specifically binds under specific binding conditions. In some aspects, a variant PD-1 containing an affinity modified IgSF domain specifically binds to the counter-structure of the corresponding native or wildtype PD-1 but with increased or attenuated affinity. A species of ligand recognized and specifically binding to its cognate receptor under specific binding conditions is an example of a counter-structure or cognate binding partner of that receptor. A "cognate cell surface binding partner" is a cognate binding partner expressed on a mammalian cell surface. A "cell surface molecular species" is a cognate binding partner of ligands of the immunological synapse (IS), expressed on and by cells, such as mammalian cells, forming the immunological synapse.

As used herein, "conjugate," "conjugation" or grammatical variations thereof refers the joining or linking together of two or more compounds resulting in the formation of another compound, by any joining or linking methods known in the art. It can also refer to a compound which is generated by the joining or linking together two or more compounds. For example, a variant PD-1 polypeptide linked directly or indirectly to one or more chemical moieties or polypeptide is an exemplary conjugate. Such conjugates include fusion proteins, those produced by chemical conjugates and those produced by any other methods.

The term "competitive binding" as used herein means that a protein is capable of specifically binding to at least two cognate binding partners but that specific binding of one cognate binding partner inhibits, such as prevents or precludes, simultaneous binding of the second cognate binding partner. Thus, in some cases, it is not possible for a protein to bind the two cognate binding partners at the same time. Generally, competitive binders contain the same or overlapping binding site for specific binding but this is not a requirement. In some embodiments, competitive binding causes a measurable inhibition (partial or complete) of specific binding of a protein to one of its cognate binding partner due to specific binding of a second cognate binding partner. A variety of methods are known to quantify competitive binding such as ELISA (enzyme linked immunosorbent assay) assays.

The term "conservative amino acid substitution" as used herein means an amino acid substitution in which an amino acid residue is substituted by another amino acid residue having a side chain R group with similar chemical properties (e.g., charge or hydrophobicity). Examples of groups of amino acids that have side chains with similar chemical properties include 1) aliphatic side chains: glycine, alanine, valine, leucine, and isoleucine; 2) aliphatic-hydroxyl side chains: serine and threonine; 3) amide-containing side chains: asparagine and glutamine; 4) aromatic side chains: phenylalanine, tyrosine, and tryptophan; 5) basic side chains: lysine, arginine, and histidine; 6) acidic side chains: aspartic acid and glutamic acid; and 7) sulfur-containing side chains: cysteine and methionine. Conservative amino acids substitution groups are: valine-leucine-isoleucine, phenylalanine-tyrosine, lysine-arginine, alanine-valine, glutamate-aspartate, and asparagine-glutamine.

The term, "corresponding to" with reference to positions of a protein, such as recitation that nucleotides or amino acid positions "correspond to" nucleotides or amino acid positions in a disclosed sequence, such as set forth in the Sequence listing, refers to nucleotides or amino acid positions identified upon alignment with the disclosed sequence based on structural sequence alignment or using a standard alignment algorithm, such as the GAP algorithm. For example, corresponding residues can be determined by alignment of a reference sequence with the sequence of wild-type PD-1 set forth in SEQ ID NO: 37 (ECD domain) by structural alignment methods as described herein. By aligning the sequences, one skilled in the art can identify corresponding residues, for example, using conserved and identical amino acid residues as guides. FIG. 5 exemplifies alignment of a sequence with the reference sequence set forth in SEQ ID NO:37 to identify corresponding residues. For example, in the exemplary alignment shown in FIG. 5, residue 112 of SEQ ID NO: 37 corresponds to residue 107 of SEQ ID NO: 392.

The terms "decrease" or "attenuate" or "suppress" as used herein means to decrease by a statistically significant amount. A decrease can be at least 10%, 20%, 30%, 40%, 50%, 60%, 70%, 80%, 90%, or 100%.

The terms "derivatives" or "derivatized" refer to modification of a protein by covalently linking it, directly or indirectly, to a composition so as to alter such characteristics as biological half-life, bioavailability, immunogenicity, solubility, toxicity, potency, or efficacy while retaining or enhancing its therapeutic benefit. Derivatives of immunomodulatory polypeptides of the invention are within the scope of the invention and can be made by, for example, glycosylation, pegylation, lipidation, or Fc-fusion.

As used herein, "domain" (typically a sequence of three or more, generally 5 or 7 or more amino acids, such as 10 to 200 amino acid residues) refers to a portion of a molecule, such as a protein or encoding nucleic acid, that is structurally and/or functionally distinct from other portions of the molecule and is identifiable. For example, domains include those portions of a polypeptide chain that can form an independently folded structure within a protein made up of one or more structural motifs and/or that is recognized by virtue of a functional activity, such as binding activity. A protein can have one, or more than one, distinct domains. For example, a domain can be identified, defined or distinguished by homology of the primary sequence or structure to related family members, such as homology to motifs. In another example, a domain can be distinguished by its function, such as an ability to interact with a biomolecule, such as a cognate binding partner. A domain independently can exhibit a biological function or activity such that the domain independently or fused to another molecule can perform an activity, such as, for example binding. A domain can be a linear sequence of amino acids or a non-linear sequence of amino acids. Many polypeptides contain a plurality of domains. Such domains are known, and can be identified by those of skill in the art. For exemplification herein, definitions are provided, but it is understood that it is well within the skill in the art to recognize particular domains by name. If needed, appropriate software can be employed to identify domains.

The term "ectodomain" as used herein refers to the region of a membrane protein, such as a transmembrane protein, that lies outside the vesicular membrane. Ectodomains often comprise binding domains that specifically bind to ligands or cell surface receptors, such as via a binding domain that specifically binds to the ligand or cell surface receptor. The ectodomain of a cellular transmembrane protein is alternately referred to as an extracellular domain.

The terms "effective amount" or "therapeutically effective amount" refer to a quantity and/or concentration of a therapeutic composition of the invention, including a protein composition or cell composition, that when administered ex vivo (by contact with a cell from a patient) or in vivo (by administration into a patient) either alone (i.e., as a monotherapy) or in combination with additional therapeutic agents, yields a statistically significant decrease in disease progression as, for example, by ameliorating or eliminating symptoms and/or the cause of the disease. An effective amount may be an amount that relieves, lessens, or alleviates at least one symptom or biological response or effect associated with a disease or disorder, prevents progression of the disease or disorder, or improves physical functioning of the patient. In the case of cell therapy, the effective amount is an effective dose or number of cells administered to a patient by adoptive cell therapy. In some embodiments the patient is a mammal such as a non-human primate or human patient.

The term "endodomain" as used herein refers to the region found in some membrane proteins, such as transmembrane proteins, that extends into the interior space defined by the cell surface membrane. In mammalian cells, the endodomain is the cytoplasmic region of the membrane protein. In cells, the endodomain interacts with intracellular constituents and can be play a role in signal transduction and thus, in some cases, can be an intracellular signaling domain. The endodomain of a cellular transmembrane protein is alternately referred to as a cytoplasmic domain, which, in some cases, can be a cytoplasmic signaling domain.

The terms "enhanced" or "increased" as used herein in the context of increasing immunological activity of a mammalian lymphocyte means to increase one or more activities the lymphocyte. An increased activity can be one or more of increase cell survival, cell proliferation, cytokine production, or T-cell cytotoxicity, such as by a statistically significant amount. In some embodiments, reference to increased immunological activity means to increase interferon gamma (IFN-gamma) production, such as by a statistically significant amount. In some embodiments, the immunological activity can be assessed in a mixed lymphocyte reaction (MLR) assay. Methods of conducting MLR assays are known in the art. Wang et al., Cancer Immunol Res. 2014 September: 2(9):846-56. Other methods of assessing activities of lymphocytes are known in the art, including any assay as described herein. In some embodiments an enhancement can be an increase of at least 10%, 20%, 30%, 40%, 50%, 75%, 100%, 200%, 300%, 400%, or 500% greater than a non-zero control value.

The term "engineered cell" as used herein refers to a mammalian cell that has been genetically modified by human intervention such as by recombinant DNA methods or viral transduction. In some embodiments, the cell is an immune cell, such as a lymphocyte (e.g. T cell, B cell, NK cell) or an antigen presenting cell (e.g. dendritic cell). The cell can be a primary cell from a patient or can be a cell line. In some embodiments, an engineered cell of the invention comprises a variant PD-1 of the invention engineered to modulate immunological activity via interactions with PD-L1 and/or PD-L2. In some embodiments, the variant PD-1 is a transmembrane immunomodulatory protein (hereinafter referred to as "TIP") containing the extracellular domain or a portion thereof containing the IgV domain linked to a transmembrane domain (e.g. a PD-1 transmembrane domain). In some cases, the TIP is formatted as a chimeric receptor containing a heterologous cytoplasmic signaling domain or endodomain. In some embodiments, an engineered cell is capable of expressing and secreting an immunomodulatory protein as described herein. Among provided engineered cells also are cells further containing an engineered T-cell receptor (TCR) or chimeric antigen receptor (CAR).

The term "engineered T-cell" as used herein refers to a T-cell such as a T helper cell, cytotoxic T-cell (alternatively, cytotoxic T lymphocyte or CTL), natural killer T-cell, regulatory T-cell, memory T-cell, or gamma delta T-cell, that has been genetically modified by human intervention such as by recombinant DNA methods or viral transduction methods. An engineered T-cell comprises a variant PD-1 transmembrane immunomodulatory protein (TIP) or secreted immunomodulatory protein (SIP) of the present invention that is expressed on the T-cell and is engineered to modulate immunological activity of the engineered T-cell itself, or a mammalian cell to which the variant PD-1 expressed on the T-cell specifically binds.

The term "engineered T-cell receptor" or "engineered TCR" refers to a T-cell receptor (TCR) engineered to specifically bind with a desired affinity to a major histocompatibility complex (MHC)/peptide target antigen that is selected, cloned, and/or subsequently introduced into a population of T-cells, often used for adoptive immunotherapy. In contrast to engineered TCRs, CARs are engineered to bind target antigens in a MHC independent manner.

The term "expressed on" as used herein is used in reference to a protein expressed on the surface of a cell, such as a mammalian cell. Thus, the protein is expressed as a membrane protein. In some embodiments, the expressed protein is a transmembrane protein. In some embodiments, the protein is conjugated to a small molecule moiety such as a drug or detectable label. Proteins expressed on the surface of a cell can include cell-surface proteins such as cell surface receptors that are expressed on mammalian cells.

The term "half-life extending moiety" refers to a moiety of a polypeptide fusion or chemical conjugate that extends the half-life of a protein circulating in mammalian blood serum compared to the half-life of the protein that is not so conjugated to the moiety. In some embodiments, half-life is extended by greater than or greater than about 1.2-fold, 1.5-fold, 2.0-fold, 3.0-fold, 4.0-fold, 5.0-fold, or 6.0-fold. In some embodiments, half-life is extended by more than 6 hours, more than 12 hours, more than 24 hours, more than 48 hours, more than 72 hours, more than 96 hours or more than 1 week after in vivo administration compared to the protein without the half-life extending moiety. The half-life refers to the amount of time it takes for the protein to lose half of its concentration, amount, or activity. Half-life can be determined for example, by using an ELISA assay or an activity assay. Exemplary half-life extending moieties include an Fc domain, a multimerization domain, polyethylene glycol (PEG), hydroxyethyl starch (HES), XTEN (extended recombinant peptides; see, WO2013130683), human serum albumin (HSA), bovine serum albumin (BSA), lipids (acylation), and poly-Pro-Ala-Ser (PAS), and polyglutamic acid (glutamylation).

The term "immunological synapse" or "immune synapse" as used herein means the interface between a mammalian cell that expresses MHC I (major histocompatibility complex) or MHC II, such as an antigen-presenting cell or tumor cell, and a mammalian lymphocyte such as an effector T cell or Natural Killer (NK) cell.

An Fc (fragment crystallizable) region or domain of an immunoglobulin molecule (also termed an Fc polypeptide) corresponds largely to the constant region of the immunoglobulin heavy chain, and is responsible for various functions, including the antibody's effector function(s). The Fc domain contains part or all of a hinge domain of an immunoglobulin molecule plus a CH2 and a CH3 domain. The Fc domain can form a dimer of two polypeptide chains joined by one or more disulfide bonds. In some embodiments, the Fc is a variant Fc that exhibits reduced (e.g. reduced greater than 30%, 40%, 50%, 60%, 70%, 80%, 90% or more) activity to facilitate an effector function. In some embodiments, reference to amino acid substitutions in an Fc region is by EU numbering system unless described with reference to a specific SEQ ID NO. EU numbering is known and is according to the most recently updated IMGT Scientific Chart (IMGT®, the international ImMunoGeneTics Information System®, http://www.imgt.org/IMGTScientific-Chart/Numbering/Hu_IGHGnber.html (created: 17 May 2001, last updated: 10 Jan. 2013) and the EU index as reported in Kabat, E. A. et al. Sequences of Proteins of Immunological interest. 5th ed. US Department of Health and Human Services, NIH publication No. 91-3242 (1991).

An immunoglobulin Fc fusion ("Fc-fusion"), such as an immunomodulatory Fc fusion protein, is a molecule comprising one or more polypeptides (or one or more small molecules) operably linked to an Fc region of an immunoglobulin. An Fc-fusion may comprise, for example, the Fc region of an antibody (which facilitates effector functions and pharmacokinetics) and a variant PD-1. An immunoglobulin Fc region may be linked indirectly or directly to one or more variant PD-1 or small molecules (fusion partners). Various linkers are known in the art and can optionally be used to link an Fc to a fusion partner to generate an Fc-fusion. Fc-fusions of identical species can be dimerized to form Fc-fusion homodimers, or using non-identical species to form Fc-fusion heterodimers. In some embodiments, the Fc is a mammalian Fc such as a murine or human Fc.

The term "host cell" refers to a cell that can be used to express a protein encoded by a recombinant expression vector. A host cell can be a prokaryote, for example, E. coli, or it can be a eukaryote, for example, a single-celled eukaryote (e.g., a yeast or other fungus), a plant cell (e.g., a tobacco or tomato plant cell), an animal cell (e.g., a human cell, a monkey cell, a hamster cell, a rat cell, a mouse cell, or an insect cell) or a hybridoma. Examples of host cells include Chinese hamster ovary (CHO) cells or their derivatives such as Veggie CHO and related cell lines which grow in serum-free media or CHO strain DX-B11, which is deficient in DHFR. Another example is Human Endothelial Kidney 293 (HEK-293) cells or their derivatives. In some embodiments, a host cell is a mammalian cell (e.g., a human cell, a monkey cell, a hamster cell, a rat cell, a mouse cell, or an insect cell).

The term "immunoglobulin" (abbreviated "Ig") as used herein refers to a mammalian immunoglobulin protein including any of the five human classes of antibody: IgA (which includes subclasses IgA1 and IgA2), IgD, IgE, IgG (which includes subclasses IgG1, IgG2, IgG3, and IgG4), and IgM. The term is also inclusive of immunoglobulins that are less than full-length, whether wholly or partially synthetic (e.g., recombinant or chemical synthesis) or naturally produced, such as antigen binding fragment (Fab), variable fragment (Fv) containing $V_H$ and $V_L$, the single chain variable fragment (scFv) containing $V_H$ and $V_L$ linked together in one chain, as well as other antibody V region fragments, such as Fab', F(ab)$_2$, F(ab')$_2$, dsFv diabody, Fc, and Fd polypeptide fragments. Bispecific antibodies, homobispecific and heterobispecific, are included within the meaning of the term.

The term "immunoglobulin superfamily" or "IgSF" as used herein means the group of cell surface and soluble proteins that are involved in the recognition, binding, or adhesion processes of cells. Molecules are categorized as members of this superfamily based on shared structural features with immunoglobulins (i.e., antibodies); they all possess a domain known as an immunoglobulin domain or fold. Members of the IgSF include cell surface antigen receptors, co-receptors and co-stimulatory molecules of the immune system, molecules involved in antigen presentation to lymphocytes, cell adhesion molecules, certain cytokine receptors and intracellular muscle proteins. They are commonly associated with roles in the immune system. Proteins in the immunological synapse are often members of the IgSF. IgSF can also be classified into "subfamilies" based on shared properties such as function. Such subfamilies typically consist of from 4 to 30 IgSF members.

The terms "IgSF domain" or "immunoglobulin domain" or "Ig domain" as used herein refers to a structural domain of IgSF proteins. Ig domains are named after the immunoglobulin molecules. They contain about 70-110 amino acids and are categorized according to their size and function. Ig-domains possess a characteristic Ig-fold, which has a sandwich-like structure formed by two sheets of antiparallel beta strands. Interactions between hydrophobic amino acids on the inner side of the sandwich and highly conserved disulfide bonds formed between cysteine residues in the B and F strands, stabilize the Ig-fold. One end of the Ig domain has a section called the complementarity determining region that is important for the specificity of antibodies for their ligands. The Ig like domains can be classified (into classes) as: IgV, IgC (which either can be an IgC1 or IgC2), or IgI. Most Ig domains are either variable (IgV) or constant (IgC). IgV domains with 9 beta strands are generally longer than IgC domains with 7 beta strands. Ig domains of some members of the IgSF resemble IgV domains in the amino acid sequence, yet are similar in size to IgC domains. These are called IgC2 domains, while standard IgC domains are called IgC1 domains. T-cell receptor (TCR) chains contain two Ig domains in the extracellular portion; one IgV domain at the N-terminus and one IgC1 domain adjacent to the cell membrane. PD-1 contains one IgV domain.

The term "IgSF species" as used herein means an ensemble of IgSF member proteins with identical or substantially identical primary amino acid sequence. Each mammalian immunoglobulin superfamily (IgSF) member defines a unique identity of all IgSF species that belong to that IgSF member. Thus, each IgSF family member is unique from other IgSF family members and, accordingly, each species of a particular IgSF family member is unique from the species of another IgSF family member. Nevertheless, variation between molecules that are of the same IgSF species may occur owing to differences in post-translational modification such as glycosylation, phosphorylation, ubiquitination, nitrosylation, methylation, acetylation, and lipidation. Additionally, minor sequence differences within a single IgSF species owing to gene polymorphisms constitute another form of variation within a single IgSF species as do wild type truncated forms of IgSF species owing to, for example, proteolytic cleavage. A "cell surface IgSF species" is an IgSF species expressed on the surface of a cell, generally a mammalian cell.

The term "immunological activity" as used herein in the context of mammalian lymphocytes such as T-cells refers to one or more cell survival, cell proliferation, cytokine production (e.g. interferon-gamma), or T-cell cytotoxicity activities. In some cases, an immunological activity can mean the cell expression of cytokines, such as chemokines or interleukins. Assays for determining enhancement or suppression of immunological activity include the MLR (mixed lymphocyte reaction) assays measuring interferon-gamma cytokine levels in culture supernatants (Wang et al., Cancer Immunol Res. 2014 September: 2(9):846-56), SEB (staphylococcal enterotoxin B) T cell stimulation assay (Wang et al., Cancer Immunol Res. 2014 September: 2(9): 846-56), and anti-CD3 T cell stimulation assays (Li and Kurlander, J Transl Med. 2010: 8: 104). Since T cell activation is associated with secretion of IFN-gamma cytokine, detecting IFN-gamma levels in culture supernatants from these in vitro human T cell assays can be assayed using commercial ELISA kits (Wu et al, Immunol Lett 2008 Apr. 15; 117(1): 57-62). Induction of an immune response results in an increase in immunological activity relative to quiescent lymphocytes. An immunomodulatory protein, such as a variant PD-1 polypeptide containing an affinity modified IgSF domain, as provided herein can in some embodiments increase or, in alternative embodiments, decrease IFN-gamma (interferon-gamma) expression in a primary T-cell assay relative to a wild-type IgSF member or IgSF domain control. Methods to assay the immunological activity of engineered cells, including to evaluate the activity of a variant PD-1 polypeptide or immunomodulatory protein, are known in the art and include, but are not limited to, the ability to expand T cells following antigen stimulation, sustain T cell expansion in the absence of re-stimulation, and anti-cancer activities in appropriate animal models. Assays also include assays to assess cytotoxicity, including a standard $^{51}$Cr-release assay (see e.g. Milone et al., (2009) Molecular Therapy 17: 1453-1464) or flow based cytotoxicity assays, or an impedance based cytotoxicity assay (Peper et al. (2014) Journal of Immunological Methods, 405:192-198).

An "immunomodulatory polypeptide" or "immunomodulatory protein" is a polypeptide or protein molecule that modulates immunological activity. By "modulation" or "modulating" an immune response is meant that immunological activity is either increased or decreased. An immunomodulatory protein can be a single polypeptide chain or a multimer (dimers or higher order multimers) of at least two polypeptide chains covalently bonded to each other by, for example, interchain disulfide bonds. Thus, monomeric, dimeric, and higher order multimeric polypeptides are within the scope of the defined term. Multimeric polypeptides can be homomultimeric (of identical polypeptide chains) or heteromultimeric (of non-identical polypeptide chains). An immunomodulatory protein of the invention comprises a variant PD-1 polypeptide.

The term "increase" as used herein means to increase by a statistically significant amount. An increase can be at least 5%, 10%, 20%, 30%, 40%, 50%, 75%, 100%, or greater than a non-zero control value.

An "isoform" of PD-1 is one of a plurality naturally occurring PD-1 polypeptides that differ in amino acid sequence. Isoforms can be the product of splice variants of an RNA transcript expressed by a single gene, or the expression product of highly similar but different genes yielding a functionally similar protein such as may occur from gene duplication. As used herein, the term "isoform" of PD-1 also refers to the product of different alleles of a PD-1 gene.

The term "lymphocyte" as used herein means any of three subtypes of white blood cell in a mammalian immune system. They include natural killer cells (NK cells) (which function in cell-mediated, cytotoxic innate immunity), T cells (for cell-mediated, cytotoxic adaptive immunity), and B cells (for humoral, antibody-driven adaptive immunity). T cells include: T helper cells, cytotoxic T-cells, natural killer T-cells, memory T-cells, regulatory T-cells, or gamma delta T-cells. Innate lymphoid cells (ILC) are also included within the definition of lymphocyte.

The terms "mammal," or "patient" specifically includes reference to at least one of a: human, chimpanzee, rhesus monkey, cynomolgus monkey, dog, cat, mouse, or rat.

The term "membrane protein" as used herein means a protein that, under physiological conditions, is attached directly or indirectly to a lipid bilayer. A lipid bilayer that forms a membrane can be a biological membrane such as a eukaryotic (e.g., mammalian) cell membrane or an artificial (i.e., man-made) membrane such as that found on a liposome. Attachment of a membrane protein to the lipid bilayer can be by way of covalent attachment, or by way of non-covalent interactions such as hydrophobic or electrostatic interactions. A membrane protein can be an integral membrane protein or a peripheral membrane protein. Membrane proteins that are peripheral membrane proteins are non-covalently attached to the lipid bilayer or non-covalently attached to an integral membrane protein. A peripheral membrane protein forms a temporary attachment to the lipid bilayer such that under the range of conditions that are physiological in a mammal, peripheral membrane protein can associate and/or disassociate from the lipid bilayer. In contrast to peripheral membrane proteins, integral membrane proteins form a substantially permanent attachment to the membrane's lipid bilayer such that under the range of conditions that are physiological in a mammal, integral membrane proteins do not disassociate from their attachment to the lipid bilayer. A membrane protein can form an attachment to the membrane by way of one layer of the lipid bilayer (monotopic), or attached by way of both layers of the membrane (polytopic). An integral membrane protein that interacts with only one lipid bilayer is an "integral monotopic protein". An integral membrane protein that interacts with both lipid bilayers is an "integral polytopic protein" alternatively referred to herein as a "transmembrane protein".

The terms "modulating" or "modulate" as used herein in the context of an immune response, such as a mammalian immune response, refer to any alteration, such as an increase or a decrease, of existing or potential immune responses that occurs as a result of administration of an immunomodulatory polypeptide comprising a variant PD-1 polypeptide of the present invention or as a result of administration of engineered cells expresses an immunomodulatory protein, such as a variant PD-1 transmembrane immunomodulatory protein of the present invention. Thus, it refers to an alteration, such as an increase or decrease, of an immune response as compared to the immune response that occurs or is present in the absence of the administration of the immunomodulatory protein comprising the variant PD-1 or cells expressing such an immunomodulatory polypeptide. Such modulation includes any induction, activation, suppression or alteration in degree or extent of immunological activity of an immune cell. Immune cells include B cells, T cells, NK (natural killer) cells, NK T cells, professional antigen-presenting cells (APCs), and non-professional antigen-presenting cells, and inflammatory cells (neutrophils, macrophages, monocytes, eosinophils, and basophils). Modulation includes any change imparted on an existing immune response, a developing immune response, a potential immune response, or the capacity to induce, regulate, influence, or respond to an immune response. Modulation includes any alteration in the expression and/or function of genes, proteins and/or other molecules in immune cells as part of an immune response. Modulation of an immune response or modulation of immunological activity includes, for example, the following: elimination, deletion, or sequestration of immune cells; induction or generation of immune cells that can modulate the functional capacity of other cells such as autoreactive lymphocytes, antigen presenting cells, or inflammatory cells; induction of an unresponsive state in immune cells (i.e., anergy); enhancing or suppressing the activity or function of immune cells, including but not limited to altering the pattern of proteins expressed by these cells. Examples include altered production and/or secretion of certain classes of molecules such as cytokines, chemokines, growth factors, transcription factors, kinases, costimulatory molecules, or other cell surface receptors or any combination of these modulatory events. Modulation can be assessed, for example, by an alteration in IFN-gamma (interferon gamma) expression relative to the wild-type PD-1 control in a primary T cell assay (see, Zhao and Ji, Exp Cell Res. 2016 Jan. 1; 340(1): 132-138). Modulation can be assessed, for example, by an alteration of an immunological activity of engineered cells, such as an alteration in in cytotoxic activity of engineered cells or an alteration in cytokine secretion of engineered cells relative to cells engineered with a wild-type PD-1 transmembrane protein The term "molecular species" as used herein means an ensemble of proteins with identical or substantially identical primary amino acid sequence. Each mammalian immunoglobulin superfamily (IgSF) member defines a collection of identical or substantially identical molecular species. Thus, for example, human PD-1 is an IgSF member and each human PD-1 molecule is a molecular species of PD-1. Variation between molecules that are of the same molecular species may occur owing to differences in post-translational modification such as glycosylation, phosphorylation, ubiquitination, nitrosylation, methylation, acetylation, and lipidation. Additionally, minor sequence differences within a single molecular species owing to gene polymorphisms constitute another form of variation within a single molecular species as do wild type truncated forms of a single molecular species owing to, for example, proteolytic cleavage. A "cell surface molecular species" is a molecular species expressed on the surface of a mammalian cell. Two or more different species of protein, each of which is present exclusively on one or exclusively the other (but not both) of the two mammalian cells forming the IS, are said to be in "cis" or "cis configuration" with each other. Two different species of protein, the first of which is exclusively present on one of the two mammalian cells forming the IS and the second of which is present exclusively on the second of the two mammalian cells forming the IS, are said to be in "trans" or "trans configuration." Two different species of protein each of which is present on both of the two mammalian cells forming the IS are in both cis and trans configurations on these cells.

The term, a "multimerization domain" refers to a sequence of amino acids that promotes stable interaction of a polypeptide molecule with one or more additional polypeptide molecules, each containing a complementary multimerization domain (e.g. a first multimerization domain and a second multimerization domain), which can be the same or a different multimerization domain. The interactions between complementary multimerization domains, e.g. interaction between a first multimerization domain and a second multimerization domain, form a stable protein-protein interaction to produce a multimer of the polypeptide molecule with the additional polypeptide molecule. In some cases, the multimerization domain is the same and interacts with itself to form a stable protein-protein interaction between two polypeptide chains. Generally, a polypeptide is joined directly or indirectly to the multimerization domain. Exemplary multimerization domains include the immunoglobulin sequences or portions thereof, leucine zippers, hydrophobic regions, hydrophilic regions, and compatible protein-protein interaction domains. The multimerization domain, for example, can be an immunoglobulin constant region or domain, such as, for example, the Fc domain or portions thereof from IgG, including IgG1, IgG2, IgG3 or IgG4 subtypes, IgA, IgE, IgD and IgM and modified forms thereof.

The terms "nucleic acid" and "polynucleotide" are used interchangeably to refer to a polymer of nucleic acid residues (e.g., deoxyribonucleotides or ribonucleotides) in either single- or double-stranded form. Unless specifically limited, the terms encompass nucleic acids containing known analogues of natural nucleotides and that have similar binding properties to it and are metabolized in a manner similar to naturally-occurring nucleotides. Unless otherwise indicated, a particular nucleic acid sequence also implicitly encompasses conservatively modified variants thereof (e.g., degenerate codon substitutions) and complementary nucleotide sequences as well as the sequence explicitly indicated (a "reference sequence"). Specifically, degenerate codon substitutions may be achieved by generating sequences in which the third position of one or more selected (or all) codons is substituted with mixed-base and/or deoxyinosine residues. The term nucleic acid or polynucleotide encompasses cDNA or mRNA encoded by a gene.

The term "non-competitive binding" as used herein means the ability of a protein to specifically bind simultaneously to at least two cognate binding partners. Thus, the protein is able to bind to at least two different cognate binding partners at the same time, although the binding interaction need not be for the same duration such that, in some cases, the protein is specifically bound to only one of the cognate binding partners. In some embodiments, the binding occurs under specific binding conditions. In some embodiments, the simultaneous binding is such that binding of one cognate binding partner does not substantially inhibit simultaneous binding to a second cognate binding partner. In some embodiments, non-competitive binding means that binding a second cognate binding partner to its binding site on the protein does not displace the binding of a first cognate binding partner to its binding site on the protein. Methods of assessing non-competitive binding are well known in the art such as the method described in Perez de La Lastra et al., Immunology, 1999 April: 96(4): 663-670. In some cases, in non-competitive interactions, the first cognate binding partner specifically binds at an interaction site that does not overlap with the interaction site of the second cognate binding partner such that binding of the second cognate binding partner does not directly interfere with the binding of the first cognate binding partner. Thus, any effect on binding of the cognate binding partner by the binding of the second cognate binding partner is through a mechanism other than direct interference with the binding of the first cognate binding partner. For example, in the context of enzyme-substrate interactions, a non-competitive inhibitor binds to a site other than the active site of the enzyme. Non-competitive binding encompasses uncompetitive binding interactions in which a second cognate binding partner specifically binds at an interaction site that does not overlap with the binding of the first cognate binding partner but binds to the second interaction site only when the first interaction site is occupied by the first cognate binding partner.

The term "pharmaceutical composition" refers to a composition suitable for pharmaceutical use in a mammalian subject, often a human. A pharmaceutical composition typically comprises an effective amount of an active agent (e.g., an immunomodulatory polypeptide comprising a variant PD-1 or engineered cells expressing a variant PD-1 transmembrane immunomodulatory protein) and a carrier, excipient, or diluent. The carrier, excipient, or diluent is typically a pharmaceutically acceptable carrier, excipient or diluent, respectively.

The terms "polypeptide" and "protein" are used interchangeably herein and refer to a molecular chain of two or more amino acids linked through peptide bonds. The terms do not refer to a specific length of the product. Thus, "peptides," and "oligopeptides," are included within the definition of polypeptide. The terms include post-translational modifications of the polypeptide, for example, glycosylations, acetylations, phosphorylations and the like. The terms also include molecules in which one or more amino acid analogs or non-canonical or unnatural amino acids are included as can be synthesized, or expressed recombinantly using known protein engineering techniques. In addition, proteins can be derivatized.

The term "primary T-cell assay" as used herein refers to an in vitro assay to measure interferon-gamma ("IFN-gamma") expression. A variety of such primary T-cell assays are known in the art. In a preferred embodiment, the assay used is an anti-CD3 coimmobilizaton assay. In this assay, primary T cells are stimulated by anti-CD3 immobilized with or without additional recombinant proteins. Culture supernatants are harvested at timepoints, usually 24-72 hours. In another embodiment, the assay used is the MLR. In this assay, primary T cells are stimulated with allogeneic APC. Culture supernatants are harvested at timepoints, usually 24-72 hours. Human IFN-gamma levels are measured in culture supernatants by standard ELISA techniques. Commercial kits are available from vendors and the assay is performed according to manufacturer's recommendation.

The term "purified" as applied to nucleic acids, such as encoding immunomodulatory proteins of the invention, generally denotes a nucleic acid or polypeptide that is substantially free from other components as determined by analytical techniques well known in the art (e.g., a purified polypeptide or polynucleotide forms a discrete band in an electrophoretic gel, chromatographic eluate, and/or a media subjected to density gradient centrifugation). For example, a nucleic acid or polypeptide that gives rise to essentially one band in an electrophoretic gel is "purified." A purified nucleic acid or protein of the invention is at least about 50% pure, usually at least about 75%, 80%, 85%, 90%, 95%, 96%, 99% or more pure (e.g., percent by weight or on a molar basis).

The term "recombinant" indicates that the material (e.g., a nucleic acid or a polypeptide) has been artificially (i.e., non-naturally) altered by human intervention. The alteration can be performed on the material within, or removed from, its natural environment or state. For example, a "recombinant nucleic acid" is one that is made by recombining nucleic acids, e.g., during cloning, affinity modification, DNA shuffling or other well-known molecular biological procedures. A "recombinant DNA molecule," is comprised of segments of DNA joined together by means of such molecular biological techniques. The term "recombinant protein" or "recombinant polypeptide" as used herein refers to a protein molecule which is expressed using a recombinant DNA molecule. A "recombinant host cell" is a cell that contains and/or expresses a recombinant nucleic acid or that is otherwise altered by genetic engineering, such as by introducing into the cell a nucleic acid molecule encoding a recombinant protein, such as a transmembrane immunomodulatory protein provided herein. Transcriptional control signals in eukaryotes comprise "promoter" and "enhancer" elements. Promoters and enhancers consist of short arrays of DNA sequences that interact specifically with cellular proteins involved in transcription. Promoter and enhancer elements have been isolated from a variety of eukaryotic sources including genes in yeast, insect and mammalian cells and viruses (analogous control elements, i.e., promoters, are also found in prokaryotes). The selection of a particular promoter and enhancer depends on what cell type is to be used to express the protein of interest. The terms "in operable combination," "in operable order" and "operably linked" as used herein refer to the linkage of nucleic acid sequences in such a manner or orientation that a nucleic acid molecule capable of directing the transcription of a given gene and/or the synthesis of a desired protein molecule is produced.

The term "recombinant expression vector" as used herein refers to a DNA molecule containing a desired coding sequence and appropriate nucleic acid sequences necessary for the expression of the operably linked coding sequence in a particular host cell. Nucleic acid sequences necessary for expression in prokaryotes include a promoter, optionally an operator sequence, a ribosome binding site and possibly other sequences. Eukaryotic cells are known to utilize promoters, enhancers, and termination and polyadenylation signals. A secretory signal peptide sequence can also, optionally, be encoded by the recombinant expression vector, operably linked to the coding sequence for the recombinant protein, such as a recombinant fusion protein, so that the expressed fusion protein can be secreted by the recombinant host cell, for easier isolation of the fusion protein from the cell, if desired. The term includes the vector as a self-replicating nucleic acid structure as well as the vector incorporated into the genome of a host cell into which it has been introduced. Among the vectors are viral vectors, such as lentiviral vectors.

The term "selectivity" refers to the preference of a subject protein, or polypeptide, for specific binding of one substrate, such as one cognate binding partner, compared to specific binding for another substrate, such as a different cognate binding partner of the subject protein. Selectivity can be reflected as a ratio of the binding activity (e.g. binding affinity) of a subject protein and a first substrate, such as a first cognate binding partner, (e.g., $K_{d1}$) and the binding activity (e.g. binding affinity) of the same subject protein with a second cognate binding partner (e.g., $K_{d2}$).

The term "sequence identity" as used herein refers to the sequence identity between genes or proteins at the nucleotide or amino acid level, respectively. "Sequence identity" is a measure of identity between proteins at the amino acid level and a measure of identity between nucleic acids at nucleotide level. The protein sequence identity may be determined by comparing the amino acid sequence in a given position in each sequence when the sequences are aligned. Similarly, the nucleic acid sequence identity may be determined by comparing the nucleotide sequence in a given position in each sequence when the sequences are aligned. Methods for the alignment of sequences for comparison are well known in the art, such methods include GAP, BESTFIT, BLAST, FASTA and TFASTA. The BLAST algorithm calculates percent sequence identity and performs a statistical analysis of the similarity between the two sequences. The software for performing BLAST analysis is publicly available through the National Center for Biotechnology Information (NCBI) website.

The term "soluble" as used herein in reference to proteins, means that the protein is not a membrane protein. In general, a soluble protein contains only the extracellular domain of an IgSF family member receptor, or a portion thereof containing an IgSF domain or domains or specific-binding fragments thereof, but does not contain the transmembrane domain. In some cases, solubility of a protein can be improved by linkage or attachment, directly or indirectly via a linker, to an Fc domain, which, in some cases, also can improve the stability and/or half-life of the protein. In some aspects, a soluble protein is an Fc fusion protein.

The term "species" as used herein with respect to polypeptides or nucleic acids means an ensemble of molecules with identical or substantially identical sequences. Variation between polypeptides that are of the same species may occur owing to differences in post-translational modification such as glycosylation, phosphorylation, ubiquitination, nitrosylation, methylation, acetylation, and lipidation. Slightly truncated sequences of polypeptides that differ (or encode a difference) from the full length species at the amino-terminus or carboxy-terminus by no more than 1, 2, or 3 amino acid residues are considered to be of a single species. Such microheterogeneities are a common feature of manufactured proteins.

The term "specific binding fragment" as used herein in reference to a full-length wild-type mammalian PD-1 polypeptide or an IgV domain thereof, means a polypeptide having a subsequence of the full-length polypeptide or an IgV domain and that specifically binds in vitro and/or in vivo to a mammalian PD-L1 and/or mammalian PD-L2 such as a human or murine PD-L1 or PD-L2. In some embodiments, the specific binding fragment comprises an PD-1 IgV that is at least 60%, 70%, 75%, 80%, 85%, 90%, 95%, 96%, 97%, 98%, or 99% the sequence length of the full-length wild-type sequence or an IgV or an IgC (e.g. IgC2) sequence thereof. The specific binding fragment can be altered in sequence to form a variant PD-1 of the invention.

The term "specifically binds" as used herein means the ability of a protein, under specific binding conditions, to bind to a target protein such that its affinity or avidity is at least 5 times as great, but optionally at least 10, 20, 30, 40, 50, 100, 250 or 500 times as great, or even at least 1000 times as great as the average affinity or avidity of the same protein to a collection of random peptides or polypeptides of sufficient statistical size. A specifically binding protein need not bind exclusively to a single target molecule but may specifically bind to a non-target molecule due to similarity in structural conformation between the target and non-target (e.g., paralogs or orthologs). Those of skill will recognize that specific binding to a molecule having the same function in a different species of animal (i.e., ortholog) or to a non-target molecule having a substantially similar epitope as the target molecule (e.g., paralog) is possible and does not detract from the specificity of binding which is determined relative to a statistically valid collection of unique non-targets (e.g., random polypeptides). Thus, a polypeptide of the invention may specifically bind to more than one distinct species of target molecule due to cross-reactivity. Solid-phase ELISA immunoassays, ForteBio Octet, or Biacore measurements can be used to determine specific binding between two proteins. Generally, interactions between two binding proteins have dissociation constants ($K_d$) less than $1\times10^{-5}$ M, and often as low as $1\times10^{-12}$ M. In certain embodiments of the present disclosure, interactions between two binding proteins have dissociation constants of less than or less than about $1\times10^{-6}$ M, $1\times10^{-7}$ M, $1\times10^{-8}$ M, $1\times10^{-9}$ M, $1\times10^{-10}$ M or $1\times10^{-11}$ M or less.

The terms "surface expresses" or "surface expression" in reference to a mammalian cell expressing a polypeptide means that the polypeptide is expressed as a membrane protein. In some embodiments, the membrane protein is a transmembrane protein.

As used herein, "synthetic," with reference to, for example, a synthetic nucleic acid molecule or a synthetic gene or a synthetic peptide refers to a nucleic acid molecule or polypeptide molecule that is produced by recombinant methods and/or by chemical synthesis methods.

The term "targeting moiety" as used herein refers to a composition that is covalently or non-covalently attached to, or physically encapsulates, a polypeptide comprising a variant PD-1 of the present invention. The targeting moiety has specific binding affinity for a desired counter-structure such as a cell surface antigen (e.g., CD28), or a tumor antigen such as tumor specific antigen (TSA) or a tumor associated antigen (TAA) such as B7-H6. Typically, the desired counter-structure is localized on a specific tissue or cell-type. Targeting moieties include: antibodies, antigen binding fragment (Fab), variable fragment (Fv) containing $V_H$ and $V_L$, the single chain variable fragment (scFv) containing $V_H$ and $V_L$ linked together in one chain, as well as other antibody V region fragments, such as Fab', F(ab)$_2$, F(ab')$_2$, dsFv diabody, nanobodies, soluble receptors, receptor ligands, affinity matured receptors or ligands, as well as small molecule (<500 dalton) compositions (e.g., specific binding receptor compositions). Targeting moieties can also be attached covalently or non-covalently to the lipid membrane of liposomes that encapsulate a polypeptide of the present invention.

The term "transmembrane protein" as used herein means a membrane protein that substantially or completely spans a lipid bilayer such as those lipid bilayers found in a biological membrane such as a mammalian cell, or in an artificial construct such as a liposome. The transmembrane protein comprises a transmembrane domain ("transmembrane domain") by which it is integrated into the lipid bilayer and by which the integration is thermodynamically stable under physiological conditions. Transmembrane domains are generally predictable from their amino acid sequence via any number of commercially available bioinformatics software applications on the basis of their elevated hydrophobicity relative to regions of the protein that interact with aqueous environments (e.g., cytosol, extracellular fluid). A transmembrane domain is often a hydrophobic alpha helix that spans the membrane. A transmembrane protein can pass through the both layers of the lipid bilayer once or multiple times. A transmembrane protein includes the provided transmembrane immunomodulatory proteins described herein. In addition to the transmembrane domain, a transmembrane immunomodulatory protein of the invention further comprises an ectodomain and, in some embodiments, an endodomain.

The terms "treating," "treatment," or "therapy" of a disease or disorder as used herein mean slowing, stopping or reversing the disease or disorders progression, as evidenced by decreasing, cessation or elimination of either clinical or diagnostic symptoms, by administration of a therapeutic composition (e.g. containing an immunomodulatory protein or engineered cells) of the invention either alone or in combination with another compound as described herein. "Treating," "treatment," or "therapy" also means a decrease in the severity of symptoms in an acute or chronic disease or disorder or a decrease in the relapse rate as for example in the case of a relapsing or remitting autoimmune disease course or a decrease in inflammation in the case of an inflammatory aspect of an autoimmune disease. As used herein in the context of cancer, the terms "treatment" or, "inhibit," "inhibiting" or "inhibition" of cancer refers to at least one of: a statistically significant decrease in the rate of tumor growth, a cessation of tumor growth, or a reduction in the size, mass, metabolic activity, or volume of the tumor, as measured by standard criteria such as, but not limited to, the Response Evaluation Criteria for Solid Tumors (RECIST), or a statistically significant increase in progression free survival (PFS) or overall survival (OS). "Preventing," "prophylaxis," or "prevention" of a disease or disorder as used in the context of this invention refers to the administration of an immunomodulatory polypeptide or engineered cells of the invention, either alone or in combination with another compound, to prevent the occurrence or onset of a disease or disorder or some or all of the symptoms of a disease or disorder or to lessen the likelihood of the onset of a disease or disorder.

The term "tumor specific antigen" or "TSA" as used herein refers to a counter-structure that is present primarily on tumor cells of a mammalian subject but generally not found on normal cells of the mammalian subject. A tumor specific antigen need not be exclusive to tumor cells but the percentage of cells of a particular mammal that have the tumor specific antigen is sufficiently high or the levels of the tumor specific antigen on the surface of the tumor are sufficiently high such that it can be targeted by anti-tumor therapeutics, such as immunomodulatory polypeptides of the invention, and provide prevention or treatment of the mammal from the effects of the tumor. In some embodiments, in a random statistical sample of cells from a mammal with a tumor, at least 50% of the cells displaying a TSA are cancerous. In other embodiments, at least 60%, 70%, 80%, 85%, 90%, 95%, or 99% of the cells displaying a TSA are cancerous.

The term "variant" (also "modified" or mutant") as used in reference to a variant PD-1 means a PD-1, such as a mammalian (e.g., human or murine) PD-1 created by human intervention. The variant PD-1 is a polypeptide having an altered amino acid sequence, relative to an unmodified or wild-type PD-1. The variant PD-1 is a polypeptide which differs from a wild-type PD-1 isoform sequence by one or more amino acid substitutions, deletions, additions, or combinations thereof. For purposes herein, the variant PD-1 contains at least one affinity modified domain, whereby one or more of the amino acid differences occurs in an IgSF domain (e.g. IgV domain or ECD). A variant PD-1 can contain 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more amino acid differences, such as amino acid substitutions. A variant PD-1 polypeptide generally exhibits at least 50%, 60%, 70%, 80%, 85%, 86%, 87%, 88%, 89%, 90%, 91%, 92%, 93%, 94%, 95%, 96%, 97%, 98%, 99% or more sequence identity to a corresponding wild-type or unmodified PD-1, such as to the sequence of SEQ ID NO:10, a mature sequence thereof (lacking the signal sequence) or a portion thereof containing the extracellular domain or an IgSF domain thereof. In some embodiments, a variant PD-1 polypeptide exhibits at least 50%, 60%, 70%, 80%, 85%, 86%, 87%, 88%, 89%, 90%, 91%, 92%, 93%, 94%, 95%, 96%, 97%, 98%, 99% or more sequence identity to a corresponding wild-type or unmodified PD-1 comprising the sequence set forth in SEQ ID NO: 37, SEQ ID NO: 244, SEQ ID NO:392 or SEQ ID NO:457. Non-naturally occurring amino acids as well as naturally occurring amino acids are included within the scope of permissible substitutions or additions. A variant PD-1 is not limited to any particular method of making and includes, for example, de novo chemical synthesis, de novo recombinant DNA techniques, or combinations thereof. A variant PD-1 of the invention specifically binds to at least one or more of PD-L1 or PD-L2 of a mammalian species. In some embodiments, the altered amino acid sequence results in an altered (i.e., increased or decreased) binding affinity or avidity to PD-L1 and/or PD-L2 compared to the wild-type or unmodified PD-1 protein. An increase or decrease in binding affinity or avidity can be determined using well known binding assays such as flow cytometry. Larsen et al., American Journal of Transplantation, Vol 5: 443-453 (2005). See also, Linsley et al., Immunity, Vol 1(9): 793-801 (1994). An increase in variant PD-1 binding affinity or avidity to PD-L1 and/or PD-L2 is to a value at least 5% greater than that of the wild-type or unmodified PD-1 and in some embodiments, at least 10%, 15%, 20%, 30%, 40%, 50%, 100% greater than that of the wild-type or unmodified PD-1 control value. A decrease in PD-1 binding affinity or avidity to PD-L1 and/or PD-L2 is to a value no greater than 95% of the wild-type or unmodified control values, and in some embodiments no greater than 80%, 70% 60%, 50%, 40%, 30%, 20%, 10%, 5%, or no detectable binding affinity or avidity of the wild-type or unmodified control values. A variant PD-1 is altered in primary amino acid sequence by substitution, addition, or deletion of amino acid residues. The term "variant" in the context of variant PD-1 is not to be construed as imposing any condition for any particular starting composition or method by which the variant PD-1 is created. A variant PD-1 can, for example, be generated starting from wild type mammalian PD-1 sequence information, then modeled in silico for binding to PD-L1 and/or PD-L2, and finally recombinantly or chemically synthesized to yield a variant PD-1 of the present invention. In but one alternative example, a variant PD-1 can be created by site-directed mutagenesis of a wild-type PD-1. Thus, variant PD-1 denotes a composition and not necessarily a product produced by any given process. A variety of techniques including recombinant methods, chemical synthesis, or combinations thereof, may be employed.

The term "wild-type" or "natural" or "native" as used herein is used in connection with biological materials such as nucleic acid molecules, proteins (e.g., PD-1), IgSF members, host cells, and the like, refers to those which are found in nature and not modified by human intervention.

II. VARIANT PD-1 POLYPEPTIDES

Provided herein are variant PD-1 polypeptides that exhibit altered (increased or decreased) binding activity or affinity for one or more of a PD-1 cognate binding partner. In some embodiments, the PD-1 cognate binding partner is PD-L1 or PD-L2. In some embodiments, the PD-1 cognate binding partner is PD-L1. In some embodiments, the variant PD-1 polypeptide contains one or more amino acids modifications, such as one or more substitutions (alternatively, "mutations" or "replacements"), deletions or additions, in an immunoglobulin superfamily (IgSF) domain (IgD) relative to a wild-type or unmodified PD-1 polypeptide or a portion of a wild-type or unmodified PD-1 containing the IgD or a specific binding fragment thereof. Thus, a provided variant PD-1 polypeptide is or comprises a variant IgD (hereinafter called "vIgD") in which the one or more amino acid modifications (e.g. substitutions) is in an IgD.

In some embodiments, the IgD comprises an IgV domain specific binding fragment of the IgV domain. Table 2 provides exemplary residues that correspond to the IgV region of PD-1. In some embodiments, the variant PD-1 polypeptide contains an IgV domain or specific binding fragment thereof in which the at least one amino acid modifications (e.g. substitutions) is in the IgV domain or a specific binding fragment thereof. In some embodiments, the variant PD-1 polypeptide contains an IgV domain or specific binding fragments thereof in which the at least one of the amino acid modifications (e.g. substitutions) is in the IgV domain or a specific binding fragment thereof. In some embodiments, by virtue of the altered binding activity or affinity, the altered IgV domain is an affinity-modified IgSF domain.

In some embodiments, the variant is modified in one more IgSF domains relative to the sequence of an unmodified PD-1 sequence. In some embodiments, the unmodified PD-1 sequence is a wild-type PD-1. In some embodiments, the unmodified or wild-type PD-1 has the sequence of a native PD-1 or an ortholog thereof. In some embodiments, the unmodified PD-1 is or comprises the extracellular domain (ECD) of PD-1 or a portion thereof containing an IgV domain (see Table 2). In some embodiments, the unmodified or wild-type PD-1 polypeptide contains the IgV domain or a specific binding fragment thereof. In some embodiments, the variant PD-L1 polypeptide contains the IgV domain or a specific binding fragment thereof. In some embodiments, the variant PD-1 is soluble and lacks a transmembrane domain. In some embodiments, the variant PD-1 further comprises a transmembrane domain and, in some cases, also a cytoplasmic domain.

In some embodiments, the wild-type or unmodified PD-1 sequence is a mammalian PD-1 sequence. In some embodiments, the wild-type or unmodified PD-1 sequence can be a mammalian PD-1 that includes, but is not limited to, human, mouse, cynomolgus monkey, or rat. In some embodiments, the wild-type or unmodified PD-1 sequence is human.

In some embodiments, the wild-type or unmodified PD-1 sequence has (i) the sequence of amino acids set forth in SEQ ID NO:10 or a mature form thereof lacking the signal sequence, (ii) a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO:10 or the mature form thereof, or (iii) is a portion of (i) or (ii) containing an IgV domain or specific binding fragment thereof.

In some embodiments, the wild-type or unmodified PD-1 sequence is or comprises an extracellular domain or portion thereof containing the IgV of the PD-1 or a specific binding fragment thereof. In some embodiments, the unmodified or wild-type PD-1 polypeptide comprises the amino acid sequence set forth in SEQ ID NO: 37, 244, 392, or 457, or an ortholog thereof. In some cases, the unmodified or wild-type PD-1 polypeptide can comprise (i) the sequence of amino acids set forth in SEQ ID NO: 37, 244, 392, or 457, (ii) a sequence of amino acids that has at least about 85%, 86%, 87%, 88%, 89%, 90%, 91%, 92%, 93%, 94%, 95%, 96%, 97%, 98%, 99% sequence identity to SEQ ID NO: 37, 244, 392, or 457, or (iii) is a specific binding fragment of the sequence of (i) or (ii). In some embodiments, the wild-type or unmodified PD-1 polypeptide comprises the amino acid sequence set forth in SEQ ID NO: 392 (corresponding to amino acid residues 26-147 of SEQ ID NO: 10), or an ortholog thereof. In some embodiments, the wild-type or unmodified PD-1 polypeptide comprises the amino acid sequence set forth in SEQ ID NO: 392 (corresponding to amino acid residues 26-147 of SEQ ID NO: 10), or an ortholog thereof. In some embodiments, the wild-type or unmodified PD-1 polypeptide comprises the amino acid sequence set forth in SEQ ID NO: 457 (corresponding to amino acid residues 33-147 of SEQ ID NO: 10), or an ortholog thereof. In some embodiments, the wild-type or unmodified PD-1 polypeptide comprises the amino acid sequence set forth in SEQ ID NO: 244 (corresponding to amino acid residues 35-145 of SEQ ID NO: 10), or an ortholog thereof. In some embodiments, the wild-type or unmodified PD-1 containing the IgV domain or specific binding fragment thereof is capable of binding one or more PD-1 cognate binding proteins, such as one or more of PD-L1 or PD-L2.

In some embodiments, the wild-type or unmodified PD-1 polypeptide contains a specific binding fragment of PD-1, such as a specific binding fragment of the IgV domain. In some embodiments the specific binding fragment can bind PD-L1 and/or PD-L2. The specific binding fragment can have an amino acid length of at least 50 amino acids, such as at least 60, 70, 80, 90, 100, or 110 amino acids. In some embodiments, a specific binding fragment of the IgV domain contains an amino acid sequence that is at least about 85%, 86%, 87%, 88%, 89%, 90%, 91%, 92%, 93%, 94%, 95%, 96%, 97%, 98%, 99% of the length of the IgV domain set forth as amino acids 35-145 of SEQ ID NO: 10.

In some embodiments, the variant PD-1 polypeptide comprises an extracellular domain or a portion thereof comprising one or more affinity modified IgSF domains. In some embodiments, the variant PD-1 polypeptides can comprise an IgV domain, or a specific binding fragment of the IgV domain in which the IgSF domain contains the one or more amino acid modifications (e.g. substitutions). In some embodiments, the variant PD-1 polypeptide comprises a full-length IgV domain. In some embodiments, the variant PD-1 polypeptide comprises a specific binding fragment of the IgV domain.

Generally, each of the various attributes of polypeptides are separately disclosed below (e.g., soluble and membrane bound polypeptides, affinity of PD-1 for PD-L1 and PD-L2, number of variations per polypeptide chain, number of linked polypeptide chains, the number and nature of amino acid alterations per variant PD-1, etc.). However, as will be clear to the skilled artisan, any particular polypeptide can comprise a combination of these independent attributes. It is understood that reference to amino acids, including to a specific sequence set forth as a SEQ ID NO used to describe domain organization of an IgSF domain are for illustrative purposes and are not meant to limit the scope of the embodiments provided. It is understood that polypeptides and the description of domains thereof are theoretically derived based on homology analysis and alignments with similar molecules. Thus, the exact locus can vary, and is not necessarily the same for each protein. Hence, the specific IgSF domain, such as specific IgV domain, can be several amino acids (such as one, two, three or four) longer or shorter.

Further, various embodiments of the invention as discussed below are frequently provided within the meaning of a defined term as disclosed above. The embodiments described in a particular definition are therefore to be interpreted as being incorporated by reference when the defined term is utilized in discussing the various aspects and attributes described herein. Thus, the headings, the order of presentation of the various aspects and embodiments, and the separate disclosure of each independent attribute is not meant to be a limitation to the scope of the present disclosure.

A. Exemplary Modifications

Provided herein are variant PD-1 polypeptides containing at least one affinity-modified IgSF domain (e.g., IgV) or a specific binding fragment thereof relative to an IgSF domain contained in a wild-type or unmodified PD-1 polypeptide such that the variant PD-1 polypeptide exhibits altered (increased or decreased) binding activity or affinity for one or more ligands PD-L1 or PD-L2 compared to a wild-type or unmodified PD-1 polypeptide. In some embodiments, a variant PD-1 polypeptide has a binding affinity for PD-L1 and/or PD-L2 that differs from that of a wild-type or unmodified PD-1 polypeptide control sequence as determined by, for example, solid-phase ELISA immunoassays, flow cytometry, ForteBio Octet or Biacore assays. In some embodiments, the variant PD-1 polypeptide has an increased binding affinity for PD-L1 and/or PD-L2. In some embodiments, the variant PD-1 polypeptide has a decreased binding affinity for PD-L2, relative to a wild-type or unmodified PD-L1 polypeptide. The PD-L1 and/or the PD-L2 can be a mammalian protein, such as a human protein or a murine protein.

Binding affinities for each of the cognate binding partners are independent; that is, in some embodiments, a variant PD-1 polypeptide has an increased binding affinity for one or both of PD-L1 and/or PD-L2, and a decreased binding affinity for one or both of PD-L1 and PD-L2, relative to a wild-type or unmodified PD-1 polypeptide.

In some embodiments, the variant PD-1 polypeptide has an increased binding affinity for PD-L1, relative to a wild-type or unmodified PD-1 polypeptide. In some embodiments, the variant PD-1 polypeptide has an increased or decreased binding affinity for PD-L2, relative to a wild-type or unmodified PD-L1 polypeptide. In some embodiments, the variant PD-1 polypeptide has an increased binding affinity for PD-L1, relative to a wild-type or unmodified PD-1 polypeptide and has a decreased binding affinity for PD-L2, relative to a wild-type or unmodified PD-1 polypeptide.

In some embodiments, a variant PD-1 polypeptide with increased or greater binding affinity to PD-L1 and/or PD-L2 will have an increase in binding affinity relative to the wild-type or unmodified PD-1 polypeptide control of at least about 5%, such as at least about 10%, 15%, 20%, 25%, 35%, or 50% for the PD-L1 and/or PD-L2. In some embodiments, the increase in binding affinity relative to the wild-type or unmodified PD-1 polypeptide is more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. In such examples, the wild-type or unmodified PD-1 polypeptide has the same sequence as the variant PD-1 polypeptide except that it does not contain the one or more amino acid modifications (e.g. substitutions).

In some embodiments, a variant PD-1 polypeptide with reduced or decreased binding affinity to PD-L2 will have decrease in binding affinity relative to the wild-type or unmodified PD-1 polypeptide control of at least 5%, such as at least about 10%, 15%, 20%, 30%, 40%, 50%, 60%, 70%, 80%, 90% or more for the PD-L2. In some embodiments, the decrease in binding affinity relative to the wild-type or unmodified PD-1 polypeptide is more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. In such examples, the wild-type or unmodified PD-1 polypeptide has the same sequence as the variant PD-1 polypeptide except that it does not contain the one or more amino acid modifications (e.g. substitutions).

In some embodiments, the equilibrium dissociation constant ($K_d$) of any of the foregoing embodiments to PD-L1 and/or PD-L2 can be less than $1\times10^{-5}$M, $1\times10^{-6}$ M, $1\times10^{-7}$ M, $1\times10^{-8}$M, $1\times10^{-9}$M, $1\times10^{-10}$ M or $1\times10^{-11}$M, or $1\times10^{-12}$ M or less.

The wild-type or unmodified PD-1 sequence does not necessarily have to be used as a starting composition to generate variant PD-1 polypeptides described herein. Therefore, use of the term "modification", such as "substitution", does not imply that the present embodiments are limited to a particular method of making variant PD-1 polypeptides. Variant PD-1 polypeptides can be made, for example, by de novo peptide synthesis and thus does not necessarily require a modification, such as a "substitution", in the sense of altering a codon to encode for the modification, e.g. substitution. This principle also extends to the terms "addition" and "deletion" of an amino acid residue which likewise do not imply a particular method of making. The means by which the variant PD-1 polypeptides are designed or created is not limited to any particular method. In some embodiments, however, a wild-type or unmodified PD-1 encoding nucleic acid is mutagenized from wild-type or unmodified PD-1 genetic material and screened for desired specific binding affinity and/or induction of IFN-gamma expression or other functional activity. In some embodiments, a variant PD-1 polypeptide is synthesized de novo utilizing protein or nucleic acid sequences available at any number of publicly available databases and then subsequently screened. The National Center for Biotechnology Information provides such information and its website is publicly accessible via the internet as is the UniProtKB database as discussed previously.

Unless stated otherwise, as indicated throughout the present disclosure, the amino acid modification(s) are designated by amino acid position number corresponding to the numbering of positions of the unmodified ECD sequence set forth in SEQ ID NO: 37 as follows:

(SEQ ID NO: 37)
PGWFLDSPDRPWNPPTFSPALLVVTEGDNATFTCSFSNTSESFVLNWYRM

SPSNQTDKLAAFPEDRSQPGQDCRFRVTQLPNGRDFHMSVVRARRNDSGT

YLCGAISLAPKAQIKESLRAELRVTERRAEVPTAHPSPSPRPAGQFQTLV

Modifications provided herein can be in a wild-type or unmodified PD-1 polypeptide set forth in SEQ ID NO: 37 or in a portion thereof contain an IgV domain or a specific binding fragment thereof. In some embodiments, the wild-type or unmodified PD-1 polypeptide contains the IgV of PD-1 as set forth in SEQ ID NO:244. In some embodiments, the unmodified PD-1 polypeptide contains an IgV that can be several amino acids longer or shorter, such as 1-15, e.g. 1, 2, 3, 4, 5, 6, 7, 8 or 9 amino acids longer or shorter, than the IgV sequence set forth in t SEQ ID NO: 244. In some embodiments, the unmodified PD-1 polypeptide has 85%, 85%, 87%, 88%, 89%, 90%, 91%, 92%, 93%, 94%, 95%, 96%, 97%, 98%, 99% sequence identity to SEQ ID NO: 37, 244, 392, or 457, or a specific binding fragment thereof. In some embodiments, the unmodified PD-1 polypeptide has the sequence set forth in any of SEQ ID NOs: 37, 244, 392, and 457.

(SEQ ID NO: 244)
PTFSPALLVVTEGDNATFTCSFSNTSESFVLNWYRMSPSNQTDKLAAFPE

DRSQPGQDCRFRVTQLPNGRDFHMSVVRARRNDSGTYLCGAISLAPKAQI

KESLRAELRVT (SEQ ID NO: 392)
DSPDRPWNPPTFSPALLVVTEGDNATFTCSFSNTSESFVLNWYRMSPSNQ

TDKLAAFPEDRSQPGQDCRFRVTQLPNGRDFHMSVVRARRNDSGTYLCGA

ISLAPKAQIKESLRAELRVTER (SEQ ID NO: 457)
NPPTFSPALLVVTEGDNATFTCSFSNTSESFVLNWYRMSPSNQTDKLAAF

PEDRSQPGQDCRFRVTQLPNGRDFHMSVVRARRNDSGTYLCGAISLAPKA

QIKESLRAELRVTER

It is within the level of a skilled artisan to identify the corresponding position of a modification, e.g. amino acid substitution, in a PD-1 polypeptide, including portion thereof containing an IgV domain, such as by alignment of a reference sequence with SEQ ID NO: 37. An exemplary alignment of SEQ ID NO: 37 containing residues 1-150 of wildtype PD-1 with SEQ ID NO: 392 containing residues 6-127 of wildtype PD-1 is shown in FIG. 5. In the listing of modifications throughout this disclosure, the amino acid position is indicated in the middle, with the corresponding unmodified (e.g. wild-type) amino acid listed before the number and the identified variant amino acid substitution listed after the number. If the modification is a deletion of the position a "del" is indicated and if the modification is an insertion at the position an "ins" is indicated. In some cases, an insertion is listed with the amino acid position indicated in the middle, with the corresponding unmodified (e.g. wild-type) amino acid listed before and after the number and the identified variant amino acid insertion listed after the unmodified (e.g. wild-type) amino acid.

In some embodiments, the variant PD-1 polypeptide has one or more amino acid modifications, e.g. substitutions, in a wild-type or unmodified PD-1 sequence. The one or more amino acid modifications, e.g. substitutions, can be in the ectodomain (extracellular domain) of the wild-type or unmodified PD-1 sequence. In some embodiments, the one or more amino acid modifications, e.g. substitutions, are in the IgV domain or specific binding fragment thereof.

In some embodiments, the variant PD-1 polypeptide has up to 1, 2, 3, 4, 5, 6, 7, 8, 9, 10, 11, 12, 13, 14, 15, 16, 17, 18, 19, or 20 amino acid modifications, e.g. substitutions. The modifications (e.g. substitutions) can be in the IgV domain. In some embodiments, the variant PD-1 polypeptide has up to 1, 2, 3, 4, 5, 6, 7, 8, 9, 10, 11, 12, 13, 14, 15, 16, 17, 18, 19, or 20 amino acid modifications, e.g. substitutions, in the IgV domain or specific binding fragment thereof. In some embodiments, the variant PD-1 polypeptide has less than 100% sequence identity and at least about 85%, 86%, 86%, 88%, 89%, 90%, 91%, 92%, 93%, 94%, 95%, 96%, 97%, 98%, or 99% sequence identity with the wild-type or unmodified PD-1 polypeptide or specific binding fragment thereof, such as with the amino acid sequence of SEQ ID NO: 37, 244, 392, or 457.

In some embodiments, the variant PD-1 polypeptide has one or more amino acid modifications, e.g. substitutions, in an unmodified PD-1 or specific binding fragment thereof corresponding to position(s) 8, 9, 11, 12, 13, 14, 16, 17, 18, 20, 21, 22, 23, 24, 25, 28, 29, 30, 31, 33, 34, 35, 36, 37, 38, 39, 40, 41, 42, 43, 44, 45, 46, 48, 50, 51, 52, 53, 54, 55, 56, 57, 58, 59, 60, 64, 66, 67, 68, 69, 70, 71, 72, 73, 75, 76, 77, 78, 79, 80, 81, 84, 85, 86, 87, 89, 90, 91, 92, 93, 94, 95, 96, 100, 102, 104, 105, 107, 109, 111, 112, 113, 114, 115, 116, 119, 120, 125, 127, 128, 129, 130, 131, 132, 133, 134, 135, 136, 137, 138, 139, 140, 141, 142, 143, or 144, with reference to positions set forth in SEQ ID NO: 37. In some embodiments, such variant PD-1 polypeptides exhibit altered binding affinity to one or more of PD-L1 and/or PD-L2 compared to the wild-type or unmodified PD-1 polypeptide. For example, in some embodiments, the variant PD-1 polypeptide exhibits increased binding affinity to PD-L1 and/or PD-L2 compared to a wild-type or unmodified PD-1 polypeptide. In some embodiments, the variant PD-1 polypeptide exhibits decreased binding affinity to PD-L1 or PD-L2 compared to a wild-type or unmodified PD-1 polypeptide.

In some embodiments, the variant PD-1 polypeptide has one or more amino acid substitutions selected from P8T, D9E, D9G, D9N, D9V, P11A, W12G, W12L, W12R, N13Y, P14H, P14L, P14S, T16A, T16I, T16S, F17I, F17V, F17Y, S18T, A20S, A20T, A20V, L21V, L22I, V23E, V23G, V24L, D28E, N29D, T31I, T31N, T31S, T33I, C34Y, S35N, F36I, F36L, F36Y, S37P, S37T, N38S, N38T, T39R, T39S, S40P, S40T, E41D, E41V, S42G, S42R, F43L, F43Y, V44M, Y48N, M50T, S51G, P52A, P52L, S53T, N54H, Q55R, T56M, T56P, T56S, K58R, L59M, L59R, L59V, E64D, E64K, R66H, R66S, S67C, S67I, S67N, S67R, P69H, G70C, G70E, G70S, Q71H, Q71K, Q71L, D72N, C73A, C73G, C73H, C73P, C73Y, F75Y, R76H, R76S, V77D, T78S, Q79P, L80Q, P81S, R84H, R84Q, D85G, D85N, F86Y, H87L, S89G, S89N, V90L, V90M, V91A, V91D, V91I, R92N, R92S, A93V, R94Q, R95L, N96T, T100A, T100I, T100S, L102F, G104A, G104T, G104V, A105C, A105G, A105L, I106L, L108T, A109G, K111M, K111N, Q113R, Q113W, I114T, K115D, K115E, K115IN, K115N, K115Q, E116D, R119H, R119L, R119P, R119Q, R119W, T125K, T125S, R127S, R128M, A129S, E130K, V131A, V131E, P132H, P132R, P132S, P132T, T133A, T133R, T133S, A134D, A134V, H135N, H135R, H135Y, P136L, P136T, S137C, P138S, P138T, S139T, P140A, P140L, P140R, R141G, R141M, R141S, R141W, P142A, P142L, P142R, P142T, A143D, A143S, A143V, G144D, or G144S, or a conservative amino acid substitution thereof. A conservative amino acid substitution is any amino acid that falls in the same class of amino acids as the substituted amino acids, other than the wild-type or unmodified amino acid. The classes of amino acids are aliphatic (glycine, alanine, valine, leucine, and isoleucine), hydroxyl or sulfur-containing (serine, cysteine, threonine, and methionine), cyclic (proline), aromatic (phenylalanine, tyrosine, tryptophan), basic (histidine, lysine, and arginine), and acidic/amide (aspartate, glutamate, asparagine, and glutamine).

In some embodiments, the variant PD-1 polypeptide has two or more amino acid substitutions selected from P8T, D9E, D9G, D9N, D9V, P11A, W12G, W12L, W12R, N13Y, P14H, P14L, P14S, T16A, T16I, T16S, F17I, F17V, F17Y, S18T, A20S, A20T, A20V, L21V, L22I, V23E, V23G, V24L, D28E, N29D, T31I, T31N, T31S, T33I, C34Y, S35N, F36I, F36L, F36Y, S37P, S37T, N38S, N38T, T39R, T39S, S40P, S40T, E41D, E41V, S42G, S42R, F43L, F43Y, V44M, Y48N, M50T, S51G, P52A, P52L, S53T, N54H, Q55R, T56M, T56P, T56S, K58R, L59M, L59R, L59V, E64D, E64K, R66H, R66S, S67C, S67I, S67N, S67R, P69H, G70C, G70E, G70S, Q71H, Q71K, Q71L, D72N, C73A, C73G, C73H, C73P, C73Y, F75Y, R76H, R76S, V77D, T78S, Q79P, L80Q, P81S, R84H, R84Q, D85G, D85N, F86Y, H87L, S89G, S89N, V90L, V90M, V91A, V91D, V91I, R92N, R92S, A93V, R94Q, R95L, N96T, T100A, T100I, T100S, L102F, G104A, G104T, G104V, A105C, A105G, A105L, I106L, L108T, A109G, K111M, K111N, Q113R, Q113W, I114T, K115D, K115E, K115IN, K115N, K115Q, E116D, R119H, R119L, R119P, R119Q, R119W, T125K, T125S, R127S, R128M, A129S, E130K, V131A, V131E, P132H, P132R, P132S, P132T, T133A, T133R, T133S, A134D, A134V, H135N, H135R, H135Y, P136L, P136T, S137C, P138S, P138T, S139T, P140A, P140L, P140R, R141G, R141M, R141S, R141W, P142A, P142L, P142R, P142T, A143D, A143S, A143V, G144D, or G144S, or a conservative amino acid substitution thereof.

In some embodiments, the variant PD-1 polypeptide contains one more modifications (e.g. amino acid substitutions) at a position corresponding to position(s) selected from 8, 9, 11, 12, 14, 16, 18, 20, 21, 22, 23, 24, 28, 31, 33, 34, 35, 36, 37, 40, 41, 42, 43, 51, 52, 59, 64, 66, 75, 80, 81, 85, 86, 89, 90, 91, 93, 94, 100, 106, 113, 114, 116, 129, 130, 132, 133, 134, 135, 136, 137, 138, 139, 140, 141, 142, 143 or 144. In some embodiments, the amino acid modification is an amino acid one or more amino acid substitution P8T, D9E, D9G, D9N, D9V, P11A, W12G, W12L, W12R, P14H, P14L, P14S, T16A, T16I, T16S, S18T, A20S, A20T, A20V, L21V, L22I, V23E, V23G, V24L, D28E, I31I, T31N, T31S, I33I, C34Y, S35N, F36I, F36L, F36Y, S37P, S37T, S40P, S40T, E41D, E41V, S42G, S42R, F43L, F43Y, S51G, P52A, P52L, L59M, L59R, L59V, E64D, E64K, R66H, R66S, F75Y, L80Q, P81S, R84H, R84Q, D85G, D85N, F86Y, S89G, S89N, V90L, V90M, V91A, V91D, V91I, A93V, R94Q, T100A, T100I, T100S, I106L, Q113R, Q113W, I114T, E116D, A129S, E130K, P132H, P132R, P132S, P132T, T133A, T133R, T133S, A134D, A134V, H135N, H135R, H135Y, P136L, P136T, S137C, P138S, P138T, S139T, P140A, P140L, P140R, R141G, R141M, R141S, R141W, P142A, P142L, P142R, P142T, A143D, A143S, A143V, G144D, or G144S, or a conservative amino acid substitution thereof.

In some embodiments, the variant PD-1 polypeptide contains one or more amino acid substitution corresponding to P8T, D9E, D9G, D9N, D9V, P11A, W12G, W12L, W12R, N13Y, P14H, P14L, P14S, T16A, I16I, T16S, F17I, F17V, F17Y, S18T, A20S, A20T, A20V, L21V, L22I, V23E, V23G, V24L, D28E, N29D, T31I, T31N, T31S, T33I, C34Y, S35N, F36I, F36L, F36Y, S37P, S37T, N38S, N38T, T39R, T39S, S40P, S40T, E41D, E41V, S42G, S42R, F43L, F43Y, V44M, Y48N, M50T, S51G, P52A, P52L, S53T, N54H, Q55R, T56M, T56P, T56S, K58R, L59M, L59R, L59V, E64D, E64K, R66H, R66S, S67C, S67I, S67N, S67R, P69H, G70C, G70E, G70S, Q71H, Q71K, Q71L, D72N, C73A, C73G, C73H, C73P, C73Y, F75Y, R76H, R76S, V77D, T78S, Q79P, L80Q, P81S, R84H, R84Q, D85G, D85N, F86Y, H87L, S89G, S89N, V90L, V90M, V91A, V91D, V91I, R92N, R92S, A93V, R94Q, R95L, N96T, T100A, T100I, T100S, L102F, G104A, G104T, G104V, A105C, A105G, A105L, I106L, L108T, A109G, K111M, K111N, Q113R, Q113W, I114T, K115D, K115E, K115IN, K115N, K115Q, E116D, R119H, R119L, R119P, R119Q, R119W, T125K, T125S, R127S, R128M, A129S, E130K, V131A, V131E, P132H, P132R, P132S, P132T, T133A, T133R, T133S, A134D, A134V, H135N, H135R, H135Y, P136L, P136T, S137C, P138S, P138T, S139T, P140A, P140L, P140R, R141G, R141M, R141S, R141W, P142A, P142L, P142R, P142T, A143D, A143S, A143V, G144D, or G144S, or a conservative substitution thereof.

In some embodiments, the variant PD-1 polypeptide contains at least one modification (e.g. substitution) at a position selected from 12, 40, 59, 73, 86, 93, 107, 112, 115, 119, 120, 133, 141 or 143. In some embodiments, at least one amino acid substitution is W12G, W12L or W12R. In some embodiments, at least one amino acid substitution is S40P or S40T. In some embodiments, at least one amino acid substitution is L59R or L59V. In some embodiments, at least one amino acid substitution is C73A, C73G, C73H, C73P, C73R, C73S or C73Y. In some embodiments, at least one amino acid substitution is F86Y. In some embodiments, at least one amino acid substitution is A93V. In some embodiments, at least one amino acid substitution is S107T. In some embodiments, at least one amino acid substitution is A112I or A112V. In some embodiments, at least one amino acid substitution is K115D, K115E, K115I, K115N or K115Q. In some embodiments, at least one amino acid substitution is R119H, R119L, R119P, R119Q or R119W. In some embodiments, at least one amino acid substitution is A120V. In some embodiments, at least one amino acid substitution is T133A, T133R or T133S. In some embodiments, at least one amino acid substitution is A143D, A143S or A143V.

In some embodiments, the variant PD-1 polypeptide contains two or more amino acid substitutions from C73A, C73G, C73H, C73P, C73R, C73S, C73Y, F86Y, S107T, A112V, K115D, K115E, K115I, K115N, K115Q, R119H, R119L, R119P, R119Q, R119W or A120V. In some embodiments, the variant PD-1 polypeptide contains amino acid substitutions from C73A/F86Y, C73G/F86Y, C73H/F86Y, C73P/F86Y, C73R/F86Y, C73S/F86Y, C73Y/F86Y, F86Y/K115D, F86Y/K115E, F86Y/K115I, F86Y/K115N, F86Y/K115Q, F86Y/R119H, F86Y/R119L, F86Y/R119P, F86Y/R119Q, F86Y/R119W, C73A/S107T, C73G/S107T, C73H/S107T, C73P/S107T, C73R/S107T, C73S/S107T, C73Y/S107T, S107T/K115D, S107T/K115E, S107T/K115I, S107T/K115N, S107T/K115Q, S107T/R119H, S107T/R119L, S107T/R119P, S107T/R119Q, S107T/R119W, C73A/A112V, C73G/A112V, C73H/A112V, C73P/A112V, C73R/A112V, C73S/A112V, C73Y/A112V, A112V/K115D, A112V/K115E, A112V/K115I, A112V/K115N, A112V/K115Q, A112V/R119H, A112V/R119L, A112V/R119P, A112V/R119Q, A112V/R119W, C73A/A120V, C73G/A120V, C73H/A120V, C73P/A120V, C73R/A120V, C73S/A120V, C73Y/A120V, K115D/A120V, K115E/A120V, K115I/A120V, K115N/A120V, K115Q/A120V, R119H/A120V, R119L/A120V, R119P/A120V, R119Q/A120V, R119W/A120V, F86Y/S107T, F86Y/A112V, F86Y/A120V, S107T/A112V, S107T/A120V or A112V/A120V.

In some embodiments, any of the provided variant PD-1 polypeptides can further contain one or more amino acid substitutions from N13D, N13S, F17L, T25A, N29S, A30V, N38D, T39A, V44H, V44R, L45I, L45V, N46I, N46V, Y48F, Y48H, R49Y, R49L, M50D, M50E, M50I, M50L, M50Q, M50V, S53D, S53G, S53L, S53N, S53V, N54C, N54D, N54G, N54S, N54Y, Q55E, Q55H, Q55K, T56A, T56L, T56V, D57F, D57R, D57V, D57Y, K58L, K58T, A61L, A61S, S67G, Q68E, Q68I, Q68L, Q68P, Q68R, Q68T, P69L, P69S, G70F, G70I, G70L, G70N, G70R, G70V, Q71P, Q71R, D72A, D72G, C73S, C73R, R76G, V77I, T78I, Q79A, Q79R, N82S, H87Q, H87R, M88L, M88F, R92G, R95K, R95G, N96D, N96S, Y101F, L102I, L102Y, L102V, G104S, A105I, A105V, S107A, S107F, S107L, S107T, S107V, L108F, L108I, L108Y, A109D, A109H, A109S, P110A, K111E, K111G, K111I, K111R, K111T, K111V, A112I, A112P, A112V, K115R, R119G, A120V, T125A, T125I, T125V, R127F, R127L, R127K, R127V, R128G, V131I, V131R.

In some embodiments, among the provided variant PD-1 polypeptides are PD-1 polypeptides that amino acid substitutions A112V/R119L/A120V, N13S/A120V/P142A, C34Y/N54D/T100S/A112V/A120V, M50V/S67N/L80Q/A120V/A143S, A112V/R119W, R84H/H87L/A112V/R119W, Q71R/V91I/A112V/R119L/A120V/T125S, A112V/K115E, M50L/L59V/R66H/A112V/H135Y/P138T/P142L, S53G/Q55R/A112V/K115E/A120V/S139T, R119W/H135R, A120V/T125I, A112V/A120V/V131A, F17I/K111E/A112V/A120V, S18T/R119Q/R141M, F36L/S37T/A112V/H135N/P138S, A112V/T125I, M50I/A112V/A120V, S67N/C73R/A93V/A112V/A120V, D72G/A112V/A120V, N96D/A112V/A120V/T125S, F86Y/R119W/T125I, R119P/T133R, K111M/A112V/K115E/P132H, S67G/A112V/T125I/T133S, A112V/A120V, S37P/A112V/R119W, W12L/S37P/A112V/R119W, A112V/R119L/A120V, D9G/A112V/A120V, T31S/S37V/A112V/T125I/A143S, S37T/A112V/T125I, R92G/A112V/A120V, E64D/F86Y/A112V/A120V, H87R/A112V/R119W, N13D/A105V/A112V/A120V/A134D, A112V/R119L/A120V/S137C, T16I/M50I/A112V/A120V, M50L/A112V/R119Q/A120V/T125I/H135R, D57V/A112V, S67N/R119W, S67N/A112V/A120V, N54Y/A112V/P140A, F43Y/P69L/R119W, N54Y/A112V/R119W, T56M/C73S/R76H/A112V/R119L/A120V/P132T/R141W, F17I/S40P/E41D/S67N/R95L/A112V/A120V/T125I/R141M, F17L/T31S/S35N/P81S/N96S/A112V/R119W, F43L/S67N/C73R/A112V/A120V, W12L/N38D/A112V/R119Q/A120V/P142T, S67N/P69H/C73R/Q79P/V91D/A112V/A120V/P136T/A143D, F17I/S40P/S67N/Q79R/A112V/R119W/T125I, F43Y/M50V/S67N/C73R/R92G/A112V/A120V/P136T, F17L/T56M/S67N/A112V/R119W/A120V/P142R, W12L/N54Y/S67N/F75Y/V91D/R95L/G104A/A112V/R119W/R141M, F17L/S37T/S67N/T78S/F86Y/A112V/R119H/A120V/V131E/A143V, N13D/S40P/A112V/R119L/A120V/S137C, F17V/A30V/E41V/R76S/A112V/R119Q/A120V/V131A, F17I/T25A/M50V/S53T/R66S/S67R/S107T/A112V/R119W/A143V, N13D/S40P/S67N/C73R/R95L/G104A/A112V/A120V, S40P/T56A/S67N/C73R/A112V/R119Q/A120V/V131A, N13Y/S40P/F43L/Q68P/R92G/A112V/R119L/A120V, F17L/S67N/Q71L/C73S/A112V/R119Q/A120V/P142L, F17I/S40P/P69S/C73S/N96S/G104A/A112V/A120V, F17I/S40P/A112V/R119L/A120V/P140R, A112V/A120V/T133S, A20S/S67N/C73R/R94Q/A112V/R119Q/A120V/T125I/P132S, N13D/S67N/C73R/R95L/A112V/R119Q/A120V/T125I, S40P/S67N/C73R/N96T/A112V/A120V, L21V/S40P/R95L/G104A/A112V/A120V/A129S/V131A/R141G, P14S/S40P/S42R/P52A/T56M/A112V/R119W/T125I/P142A, S40P/F43L/T56A/S67N/C73S/A112V/R119L/A120V, F17I/S40P/M50V/S67N/C73S/R95L/G104A/A112V/R119L/A120V, S40P/T56M/C73S/R95L/A112V/R119W/T125I/V131A/R141W, F17I/A20V/S51G/N54D/F86Y/A112V/A120V/T125I, F17I/T31N/T56M/S67N/C73R/G104A/A112V/R119Q/A120V/T133A/P140L, F17V/S40P/R92G/R95L/A112V/R119W, W12G/F17L/T56V/S67N/A112V/R119W/V131E/R141S, F86Y/R92G/A112V/R119L/A120V/T125K/T133S, P8T/F17I/S67N/F86Y/G104A/A112V/A120V/S139T, F17I/S40P/A112V/R119W/G144D, L22I/S67I/G70S/Q71R/S107T/A112V/R119L/A120V/T125I/T133S, S40P/A112V/A120V, T16S/S67N/C73R/A112V/R119W, N13D/S40P/A112V/A120V/T125I/T133S, M50L/V91D/A112V/R119W/P132R/R141G, F17I/S40P/M50I/S67R/A112V/R119L/A120V/S137C, S40P/A112V/R119W, F17I/V24L/A112V/

R119W, S40P/S67N/C73R/A93V/A112V/A120V, N13D/F17I/A112V/R119W/R141M, S67N/C73R/A112V/A120V/R141S, A112V/R119L/A120V, W12R/L59V/R66H/F86Y/V90L/A112V/K115N/R119L/A120V, F36L/M50I/S51G/C73R/S107T/K111M/A120V/V131E, M50V/R119W/A120V/T125I/R141G, A109G/A112V/K115E/R119W, Q55R/R76H/A112V/K115I/A120V, W12R/F86Y/R95L/A112V/R119P/T133R, S67N/C73Y/A112V, F17I/S40P/T56S/A112V, W12L/P14S/M50V/S67R/A93V/R94Q/K111T/A112V/R119W/A120V, F36L/L59S/S67N/A105L/A112V/R119W/A120V/A143V, L59M/E64K/F86Y/R94Q/A112V/R119L/A120V/T125I/T133S, P14H/F17Y/T39R/S40T/K58R/V77D/G104V/A112V/Q113R/I114T/A143V, D57V/L59M/P69S/C73S/A112V/R119L/A120V/A134V, V23E/T39S/S40P/C73Y/V91A/R92N/L102F/A112V/R119W/A120V, T16A/F17I/F36L/S67N/C73R/H87L/R92G/R95L/A112V/R119W, C73S/A105V/A112V/R119W/A120V/T133A, P14S/M50L/L59V/R66H/G70S/C73R/A112V/A120V/T125I/G144S, P8T/S40P/S53N/R95L/A112V/A120V/T125I/R128M/P138T/R141G, S37T/T56M/C73S/D85N/A109G/A112V/A120V/H135Y/A143S, S67N/C73R/A93V/G104A/A112V/R119Q/R127S/H135R, S40P/S67N/C73R/A112V/A120V, S67N/C73R/A93V/A112V/R119W, C73R/A93V/A112V/R119W, S67N/C73R/A112V/A120V, N13D/P69H/C73R/A93V/A112V/R119W/R141S, F17I/N38D/S40P/S67N/C73R/A112V/A120V, N13D/F17I/S40P/T56M/R66S/S67N/G70C/A112V/A120V/R141S, S40P/F43L/R66S/S67N/G70C/A112V/R119L/A120V, V23G/S40T/G104A/A112V/R119L/A120V, W12R/F36I/N54Y/S67I/C73S/A93V/G104A/A112V/K115Q/R119W, S40P/M50L/S67I/C73S/R92G/A93V/A112V/A120V/R141S, F17I/T25A/S40P/F43Y/S67N/C73R/F86Y/A112V/R119W/T125I, F17I/S40P/M50L/S67I/C73S/A112V/A120V/E130K/P136L, W12R/S40P/S67N/C73R/A93V/A112V/A120V/R141S, F17I/S40P/M50L/S67I/C73S/R92G/A93V/A112V/A120V/R141S, F17I/S40P/M50L/S67I/A112V/A120V/R141S, V23G/T56P/S67I/C73S/F86Y/R92G/G104A/A112V/R119W/A143D, F17I/S40P/M50L/S67I/C73S/R92G/A93V/A112V/R119W/T125I, D9V/P11A/N13D/S40T/T56M/S67N/R95L/G104A/A112V/R119L/A120V, F17I/T25A/S40P/F43Y/S67N/A112V/R119L/A120V, D9E/F17I/S40P/M50L/S67I/C73S/V90M/T100A/G104A/K111M/A112V/R119W/A120V/A143D, F17I/S40P/M50L/S67I/C73S/R92G/A93V/A112V/A120V/R141G, F17I/S40P/S67N/S89G/R95L/A112V/R119W/T125I, F17I/S40P/M50L/S67I/C73S/R92G/A93V/K111M/A112V/R119Q/A120V, D9N/F17I/T31N/S40P/M50L/S67I/C73S/R92G/A93V/A112V/A120V/R141S, N13D/S40T/T56M/S67N/R95L/G104A/K111R/A112V/A120V/T125I, W12G/F17I/S40P/M50L/A112V/P132T, D9N/F17I/S40P/M50T/T56A/G70S/C73R/R92G/A93V/A112V/A120V/R141S, N38S/L59M/Q71L/S107T/A112V/K115E/R119Q/A120V, M50V/L59M/A112V/R119Q/A120V, P81S/F86Y/R92S/S107T/A112V/K115E/A120V, C73R/R84Q/F86Y/S107T/A112V/K115D/A120V, W12G/M50T/S53N/S67R/G70S/C73R/G104V/A112V/K115E/R119W, T31I/F36Y/F43Y/S67N/G70S/C73R/V90M/A112V/R119W, R76S/S107T/K111N/A112V/K115N/A120V, F86Y/A112V/R119W/A120V, N13S/M50I/R76S/S107T/A112V/K115N/R119W/A120V, P14H/T16S/M50L/C73R/R84Q/F86Y/S107T/A112V/K115E/A120V, F17L/T25A/L59M/E64K/F86Y/R94Q/S107T/A112V/K115N/R119W/A120V, Q71R/F86Y/A112V/K115E/R119Q/A120V, R76S/S107T/A112V/K115N/R119W/A120V, M50I/A112V/K115D/A120V, M50V/P81S/F86Y/R92S/S107T/A112V/K115E/A120V, M50I/S67N/G70R/K111T/A112V/R119W/A120V, P14H/T16S/M50L/L80Q/K111M/R119Q/A120V, T31I/F36Y/E64K/A112V/K115E/R119Q/A120V, S107T/A112V/R119W/A120V, T56S/A112V/K115E/A120V, T56S/A112V/R119W, N46I/Y48N/D57Y/S67C/V90L/A112V, T56S/A112V/R119P, P14H/F17I/V44M/A112V/K115E/A120V, N38S/T56S/A112V/K115E/A120V, S42G/M50L/P69S/F86Y/A112V/K115E, P14H/T56S/A112V/K115E/A120V, N13S/S67N/G70C/F86Y/S89N/V91D/A112V/R119L/A120V, W12G/S67N/Q71R/F86Y/K111M/A112V/K115Q/R119W, S67N/C73R/V91D/S107T/K111M/A112V/K115Q/R119W, N13S/M50I/R76S/S107T/K111M/A112V/K115Q/R119W, T33I/S67N/G70S/S107T/K111N/A112V/K115E/R119W, P69L/F86Y/V90M/T100I/S107T/K111N/A112V/K115N/A120V, F17L/T25A/P69L/F86Y/V90M/T100I/S107T/K111N/A112V/K115N/A120V, T33I/M50I/R76S/F86Y/S107T/A112V/K115N/R119W/A120V, N13S/S67N/C73R/F86Y/S107T/A112V/Q113R/K115E/A120V, S67N/C73R/F86Y/V91D/S107T/A112V/K115D/A120V, F17L/T25A/S67N/C73R/R84Q/F86Y/A93V/A112V/K115E/R119W, T56S/A112V/K115E, P69L/V91D/A112V/K115N/R119W/A120V, N13S/E41D/M50I/G70V/D72N/F86Y/R94Q/A112V/R119L/A120V, M50I/P69L/F86Y/V90M/T100I/S107T/K111N/A112V/K115N/A120V, M50I/C73R/S107T/K111N/A112V/K115N/A120V, F86Y/A112V/K115N/R119W, M50I/S67N/C73R/F86Y/R95L/S107T/A112V/K115N/R119W, M50L/Q68R/P69S/F86Y/S107T/A112V/K115N/R119W, N38T/A112V/K115N/R119L/A120V, S67N/Q71H/F86Y/R95L/S107T/A112V/K115N/R119W, A20T/D28E/F36L/M50I/Q68R/P69S/F86Y/A112V/R119L/A120V, M50I/S67N/C73R/F86Y/R95L/A112V/Q113W/R119L/A120V, L59M/S67N/Q71L/C73R/R95L/S107T/A112V/K115N/R119W, P52L/S53N/C73S/A112V/E116D/R119W, Q71R/C73R/A112V/K115N/R119L/A120V, W12L/A20T/N29D/S37P/L59M/Q68R/P69S/F86Y/A112V/R119L/A120V, N46I/Y48F/D57V/P69L/A112V/K115N/R119W, M50I/S67N/C73R/F86Y/R95L/S107T/A112V/K115Q/R119Q/A120V, N54D/P69H/C73R/F86Y/R95L/S107T/A112V/K115N/R119W, T56S/Q71K/F86Y/R95L/S107T/A112V/K115N/R119W, C73A/F86Y/S107T/A112V/K115N/R119Q/A120V, C73R/F86Y/A105G/S107T/A112V/K115N/R119L/A120V, N54H/G70E/C73P/F86Y/A112V/K115D/R119L/A120V, C73G/F86Y/S107T/A112V/K115N/R119Q/A120V, N54S/C73G/F86Y/S107T/A112V/K115D/R119L/A120V, F86Y/S107T/A112V/K115D/R119W/A120V, G70E/C73P/F86Y/S107T/A112V/K115E/R119Q/A120V, C73G/F86Y/A105G/S107T/A112V/K115D/R119W, C73G/F86Y/S107T/A112V/K115D/R119L/A120V, C73S/F86Y/S107T/A112V/K115D/R119L/A120V, L45V/C73G/F86Y/G104A/S107T/A112V/K115N/R119W/A120V, C73P/F86Y/S107T/A112V/K115D/R119Q/A120V, C73S/F86Y/S107T/A112V/K115E/R119Q/A120V, C73S/F86Y/G104T/S107T/A112V/K115E/R119W/A120V, C73R/F86Y/S107T/K111R/A112V/K115D/A120V, P14L/C73G/F86Y/S107T/A112V/K115D/R119L/A120V, G70E/F86Y/S107T/A112V/K115D/R119L/A120V, C73G/F86Y/G104V/S107T/A112V/K115N/R119L/A120V, C73S/F86Y/G104S/S107T/L108F/A112V/K115D/R119L/A120V, C73S/F86Y/S107T/A112V/K115D/A120V, C73R/F86Y/S107T/A112V/K115D/R119L/A120V, C73S/F86Y/S107T/A112V/Q113R/K115D/R119L/A120V, C73S/F86Y/V91A/S107T/A112V/K115D/R119L/A120V, G70E/C73P/F86Y/A105G/S107T/A112V/K115D/R119Q/A120V, C73G/F86Y/A105G/S107T/A112V/K115D/R119L/A120V, C73G/F86Y/A105G/S107T/A112V/Q113R/K115D/R119L/A120V, F86Y/S107T/A112V/K115D/R119Q/A120V, C73R/F86Y/S107T/A112V/K115N/R119L/A120V, C73A/F86Y/S107T/A112V/Q113R/K115E/R119Q/

A120V, C73R/F86Y/S107T/A112V/K115D/R119Q/A120V, C73G/F86Y/A112V/K115D/R119W/A120V, C73P/F86Y/A105G/S107T/A112V/Q113R/K115D/R119L/A120V, C73R/F86Y/A105G/S107T/A112V/K115D/R119L/A120V, C73A/F86Y/S107T/A112V/K115D/R119L/A120V, P69S/C73R/F86Y/S107T/A112V/K115D/R119W/A120V, C73S/F86Y/G104S/S107T/A112V/K115E/R119W/A120V, Q68R/C73S/F86Y/S107T/A112V/K115D/R119Q/A120V, C73R/F86Y/S107T/A112V/K115N/R119Q/A120V, G70E/C73R/F86Y/S107T/A112V/K115N/R119Q/A120V, C73S/F86Y/S107T/A112V/K115D/R119W/A120V, G70E/F86Y/G104T/I106L/S107T/L108T/A112V/K115N/R119L/A120V, C73H/F86Y/A105G/S107T/A112V/K115D/R119L/A120V, G70E/C73P/F86Y/A105C/S107T/A112V/K115D/R119L/A120V, G70E/C73P/F86Y/S107T/A112V/K115D/R119Q/A120V, C73S/F86Y/S107T/K111R/A112V/K115E/R119L/A120V, C73R/D85G/F86Y/A105G/S107T/A112V/K115D/R119Q/A120V, C73R/F86Y/S107T/A112V/K115E/R119W/A120V, N54S/C73G/F86Y/S107T/A112V/K115E/R119Q/A120V, C73S/F86Y/G104S/S107T/A112V/K115N/R119L/A120V, F17L/Q71R/C73G/F86Y/A105G/S107T/A112V/K115D/R119L/A120V, C73G/F86Y/S107T/A112V/K115E/R119W/A120V, G70E/C73G/F86Y/A105C/S107T/A112V/K115E/R119L/A120V, C73G/F86Y/G104A/S107T/A112V/K115D/R119W/A120V, C73S/F86Y/S107T/A112V/K115N/A120V, C73P/F86Y/S107T/A112V/K115N/R119L/A120V, W12R/F86Y/S107T/A112V/K115D/R119Q/A120V, G70E/C73G/F86Y/A105L/A112V/K115N/R119Q/A120V, or F86Y/S107T/A112V/K115N/R119W/A120V.

In some embodiments, the variant PD-1 polypeptide comprises any of the substitutions (mutations) listed in Table 1. Table 1 also provides exemplary sequences by reference to SEQ ID NO for the extracellular domain (ECD) or IgV domain of wild-type PD-1 or exemplary variant PD-1 polypeptides. As indicated, the exact locus or residues corresponding to a given domain can vary, such as depending on the methods used to identify or classify the domain. Also, in some cases, adjacent N- and/or C-terminal amino acids of a given domain (e.g. ECD or IgV) also can be included in a sequence of a variant IgSF polypeptide, such as to ensure proper folding of the domain when expressed. Thus, it is understood that the exemplification of the SEQ ID NOs in Table 1 is not to be construed as limiting. For example, the particular domain, such as the ECD or IgV domain, of a variant PD-1 polypeptide can be several amino acids longer or shorter, such as 1-15, e.g. 1, 2, 3, 4, 5, 6, 7, 8 or 9 amino acids longer or shorter, than the sequence of amino acids set forth in the respective SEQ ID NO.

In some embodiments, the variant PD-1 polypeptide is or comprises any of the sequences set forth in SEQ ID NOS: 103-243, 454-456, 490-548 or 869-926. In some embodiments, the variant PD-1 polypeptide is or comprises a polypeptide sequence that exhibits at least 90% identity, at least 91% identity, at least 92% identity, at least 93% identity, at least 94% identity, at least 95% identity, such as at least 96% identity, 97% identity, 98% identity, or 99% identity to any of the sequences set forth in any one of SEQ ID NOS: 103-243, 454-456, 490-548, or 869-926 and that contains the amino acid modification(s), e.g. substitution(s), therein not present in the wild-type or unmodified PD-1. In some embodiments, the variant PD-1 polypeptide is or comprises a specific binding fragment of any of any one of SEQ ID NOS: 103-243, 454-456, 490-548, 869-926 and contains the amino acid modification(s), e.g. substitution(s), therein not present in the wild-type or unmodified PD-1.

In some embodiments, the variant PD-1 polypeptide is or comprises the sequence set forth in any one of SEQ ID NOS: 393-451, 454-456, 647-759, 761-777, 779-780, 811-868. In some embodiments, the variant PD-1 polypeptide is or comprises a polypeptide sequence that exhibits at least 90% identity, at least 91% identity, at least 92% identity, at least 93% identity, at least 94% identity, at least 95% identity, such as at least 96% identity, 97% identity, 98% identity, or 99% identity to any of the sequences set forth in SEQ ID NOS: 393-451, 454-456, 647-759, 761-777, 779-780 or 811-868 and contains the amino acid modification(s), e.g. substitution(s) therein not present in the wild-type or unmodified PD-1. In some embodiments, the variant PD-1 polypeptide is or comprises a specific binding fragment of any one of SEQ ID NOS: 393-451, 454-456, 647-759, 761-777, 779-780 or 811-868) and that contains the amino acid modification(s), e.g. substitution(s) therein, not present in the wild-type or unmodified PD-1.

In some embodiments, the variant PD-1 polypeptide is or comprises any of the sequences set forth in any one of SEQ ID NOS: 245-375, 549-606, 927-982. In some embodiments, the variant PD-1 polypeptide is or comprises a polypeptide sequence that exhibits at least 90% identity, at least 91% identity, at least 92% identity, at least 93% identity, at least 94% identity, at least 95% identity, such as at least 96% identity, 97% identity, 98% identity, or 99% identity to any of sequences set forth in any one of SEQ ID NOS: 245-375, 549-606, 927-982 and contains the amino acid modification(s), e.g. substitution(s), therein not present in the wild-type or unmodified PD-1. In some embodiments, the variant PD-1 polypeptide is or comprises a specific binding fragment of any one of SEQ ID NOS: 245-375, 549-606, 927-982 and contains the amino acid modification(s), e.g. substitution(s), therein not present in the wild-type or unmodified PD-1.

TABLE 1

Exemplary variant PD-1 polypeptides

| | SEQ ID NO | | |
|---|---|---|---|
| Mutation(s) | ECD (1-150) | IgV (6-127) | IgV (15-125) |
| Wild-type | 37 | 392 | 244 |
| A112V/R119L/A120V | 103 | 647 | 245 |
| N13S/A120V/P142A | 104 | 648 | 284 |
| C34Y/N54D/T100S/A112V/A120V | 105 | 649 | 246 |
| M50V/S67N/L80Q/A120V/A143S | 106 | 650 | 247 |
| A112V/R119W | 107 | 651 | 248 |
| R84H/H87L/A112V/R119W | 108 | 652 | 249 |
| Q71R/V91I/A112V/R119L/A120V/T125S | 109 | 653 | 250 |
| A112V/K115E | 110 | 654 | 251 |

TABLE 1-continued

Exemplary variant PD-1 polypeptides

| | SEQ ID NO | | |
|---|---|---|---|
| Mutation(s) | ECD (1-150) | IgV (6-127) | IgV (15-125) |
| M50L/L59V/R66H/A112V/H135Y/P138T/P142L | 111 | 655 | 252 |
| R119W | 112 | 656 | 253 |
| S53G/Q55R/A112V/K115E/A120V/S139T | 113 | 657 | 254 |
| R119W/H135R | 114 | 656 | 253 |
| A120V/T125I | 115 | 659 | 255 |
| A112I/A120V/V131A | 116 | 660 | 256 |
| F17I/K111E/A112V/A120V | 117 | 661 | 257 |
| S18T/R119Q/R141M | 118 | 662 | 258 |
| F36L/S37T/A112V/H135N/P138S | 119 | 663 | 259 |
| A112V/T125I | 120 | 664 | 260 |
| M50I/A112V/A120V | 121 | 665 | 261 |
| S67N/C73R/A93V/A112V/A120V | 122 | 666 | 262 |
| D72G/A112V/A120V | 123 | 667 | 263 |
| N96D/A112V/A120V/T125S | 124 | 668 | 264 |
| F86Y/R119W/T125I | 125 | 669 | 265 |
| R119P/T133R | 126 | 670 | 266 |
| K111M/A112V/K115E/P132H | 127 | 671 | 267 |
| S67G/A112V/T125I/T133S | 128 | 672 | 268 |
| A112V/A120V | 129 | 660 | 256 |
| S37P/A112V/R119W | 130 | 674 | 269 |
| W12L/S37P/A112V/R119W | 131 | 675 | 269 |
| D9G/A112V/A120V | 132 | 676 | 256 |
| T31S/S37T/A112V/T125I/A143S | 133 | 677 | 270 |
| S37T/A112V/T125I | 134 | 678 | 271 |
| R92G/A112V/A120V | 135 | 679 | 272 |
| E64D/F86Y/A112V/A120V | 136 | 680 | 273 |
| H87R/A112V/R119W | 137 | 681 | 274 |
| N13D/A105V/A112V/A120V/A134D | 138 | 682 | 275 |
| A112V/R119L/A120V/S137C | 139 | 647 | 245 |
| T16I/M50I/A112V/A120V | 140 | 684 | 276 |
| M50L/A112V/R119Q/A120V/T125I/H135R | 141 | 685 | 277 |
| D57V/A112V | 142 | 686 | 278 |
| S67N/R119W | 143 | 687 | 279 |
| S67N/A112V/A120V | 144 | 688 | 280 |
| N54Y/A112V/P140A | 145 | 689 | 281 |
| F43Y/P69L/R119W | 146 | 690 | 282 |
| N54Y/A112V/R119W | 147 | 691 | 283 |
| A120V | 148 | 692 | 284 |
| T56M/C73S/R76H/A112V/R119L/A120V/P132T/R141W | 149 | 693 | 285 |
| F17I/S40P/E41D/S67N/R95L/A112V/A120V/T125I/R141M | 150 | 694 | 286 |
| F17L/T31S/S35N/P81S/N96S/A112V/R119W | 151 | 695 | 287 |
| F43L/S67N/C73R/A112V/A120V | 152 | 696 | 288 |
| W12L/N38D/A112V/R119Q/A120V/P142T | 153 | 697 | 289 |
| S67N/P69H/C73R/Q79P/V91D/A112V/A120V/P136T/A143D | 154 | 698 | 290 |
| F17I/S40P/S67N/Q79R/A112V/R119W/T125I | 155 | 699 | 291 |
| F43Y/M50V/S67N/C73R/R92G/A112V/A120V/P136T | 156 | 700 | 292 |
| F17L/T56M/S67N/A112V/R119W/A120V/P142R | 157 | 701 | 293 |
| W12L/N54Y/S67N/F75Y/V91D/R95L/G104A/A112V/R119W/R141M | 158 | 702 | 294 |
| F17L/S37T/S67N/T78S/F86Y/A112V/R119H/A120V/V131E/A143V | 159 | 703 | 295 |
| N13D/S40P/A112V/R119L/A120V/S137C | 160 | 704 | 296 |
| F17V/A30V/E41V/R76S/A112V/R119Q/A120V/V131A | 161 | 705 | 297 |
| F17I/T25A/M50V/S53T/R66S/S67R/S107T/A112V/R119W/A143V | 162 | 706 | 298 |
| N13D/S40P/S67N/C73R/R95L/G104A/A112V/A120V | 163 | 707 | 299 |
| S40P/T56A/S67N/C73R/A112V/R119Q/A120V/V131A | 164 | 708 | 300 |
| N13Y/S40P/F43L/Q68P/R92G/A112V/R119L/A120V | 165 | 709 | 301 |
| F17L/S67N/Q71L/C73S/A112V/R119Q/A120V/P142L | 166 | 710 | 302 |
| F17I/S40P/P69S/C73S/N96S/G104A/A112V/A120V | 167 | 711 | 303 |
| F17I/S40P/A112V/R119L/A120V/P140R | 168 | 712 | 304 |
| A112V/A120V/T133S | 169 | 660 | 256 |
| A20S/S67N/C73R/R94Q/A112V/R119Q/A120V/T125I/P132S | 170 | 714 | 305 |
| N13D/S67N/C73R/R95L/A112V/R119Q/A120V/T125I | 171 | 715 | 306 |
| S40P/S67N/C73R/N96T/A112V/A120V | 172 | 716 | 307 |
| L21V/S40P/R95L/G104A/A112V/A120V/A129S/V131A/R141G | 173 | 717 | 308 |
| P14S/S40P/S42R/P52A/T56M/A112V/R119W/T125I/P142A | 174 | 718 | 309 |
| S40P/F43L/T56A/S67N/C73S/A112V/R119L/A120V | 175 | 719 | 310 |
| F17I/S40P/M50V/S67N/C73S/R95L/G104A/A112V/R119L/A120V | 176 | 720 | 311 |
| S40P/T56M/C73S/R95L/A112V/R119W/T125I/V131A/R141W | 177 | 721 | 312 |
| F17I/A20S/S51G/N54Y/F86Y/A112V/A120V/T125I | 178 | 722 | 313 |
| F17I/T31N/T56M/S67N/C73R/G104A/A112V/R119Q/A120V/T133A/P140L | 179 | 723 | 314 |
| F17V/S40P/R92G/R95L/A112V/R119W | 180 | 724 | 315 |
| W12G/F17L/T56V/S67N/A112V/R119W/V131E/R141S | 181 | 725 | 316 |
| F86Y/R92G/A112V/R119L/A120V/T125K/T133S | 182 | 726 | 317 |
| P8T/F17I/S67N/F86Y/G104A/A112V/A120V/S139T | 183 | 727 | 318 |

TABLE 1-continued

Exemplary variant PD-1 polypeptides

| Mutation(s) | SEQ ID NO | | |
|---|---|---|---|
| | ECD (1-150) | IgV (6-127) | IgV (15-125) |
| F17I/S40P/A112V/R119W/G144D | 184 | 728 | 319 |
| L22I/S67I/G70S/Q71R/S107T/A112V/R119L/A120V/T125I/T133S | 185 | 729 | 320 |
| S40P/A112V/A120V | 186 | 730 | 321 |
| T16S/S67N/C73R/A112V/R119W | 187 | 731 | 322 |
| N13D/S40P/A112V/A120V/T125I/T133S | 188 | 732 | 323 |
| M50L/V91D/A112V/R119W/P132R/R141G | 189 | 733 | 324 |
| F17I/S40P/M50I/S67R/A112V/R119L/A120V/S137C | 190 | 734 | 325 |
| S40P/A112V/R119W | 191 | 456 | 326 |
| F17I/V24L/A112V/R119W | 192 | 735 | 327 |
| S40P/S67N/C73R/A93V/A112V/A120V | 193 | 736 | 363 |
| N13D/F17I/A112V/R119W/R141M | 194 | 737 | 329 |
| S67N/C73R/A112V/A120V/R141S | 195 | 738 | 330 |
| W12R/L59V/R66H/F86Y/V90L/A112V/K115N/R119L/A120V | 196 | 455 | 331 |
| F36L/M50I/S51G/C73R/S107T/K111M/A120V/V131E | 197 | 739 | 332 |
| M50V/R119W/A120V/T125I/R141G | 198 | 740 | 333 |
| A109G/A112V/K115E/R119W | 199 | 741 | 334 |
| Q55R/R76H/A112V/K115I/A120V | 200 | 742 | 335 |
| W12R/F86Y/R95L/A112V/R119P/T133R | 201 | 743 | 336 |
| S67N/C73Y/A112V | 202 | 744 | 337 |
| F17I/S40P/T56S/A112V | 203 | 454 | 338 |
| W12L/P14S/M50V/S67R/A93V/R94Q/K111T/A112V/R119W/A120V | 204 | 745 | 339 |
| F36L/L59R/S67N/A105L/A112V/R119W/A120V/A143V | 205 | 746 | 340 |
| L59M/E64K/F86Y/R94Q/A112V/R119L/A120V/T125I/T133S | 206 | 747 | 341 |
| P14H/F17Y/T39R/S40T/K58R/V77D/G104V/A112V/Q113R/I114T/A143V | 207 | 748 | 342 |
| D57V/L59M/P69S/C73S/A112V/R119L/A120V/A134V | 208 | 749 | 343 |
| V23E/T39S/S40P/C73Y/V91A/R92N/L102F/A112V/R119W/A120V | 209 | 750 | 344 |
| T16A/F17I/F36L/S67N/C73R/H87L/R92G/R95L/A112V/R119W | 210 | 751 | 345 |
| C73S/A105V/A112V/R119W/A120V/T133A | 211 | 752 | 346 |
| P14S/M50L/L59V/R66H/G70S/C73R/A112V/A120V/T125I/G144S | 212 | 753 | 347 |
| P8T/S40P/S53N/R95L/A112V/A120V/T125I/R128M/P138T/R141G | 213 | 754 | 348 |
| S37T/T56M/C73S/D85N/A109G/A112V/A120V/H135Y/A143S | 214 | 755 | 349 |
| S67N/C73R/A93V/G104A/A112V/R119Q/R127S/H135R | 215 | 756 | 350 |
| S40P/S67N/C73R/A112V/A120V | 216 | 757 | 351 |
| S67N/C73R/A93V/A112V/R119W | 217 | 758 | 352 |
| C73R/A93V/A112V/R119W | 218 | 759 | 353 |
| S67N/C73R/A112V/A120V | 219 | 738 | 330 |
| N13D/P69H/C73R/A93V/A112V/R119W/R141S | 220 | 761 | 354 |
| F17I/N38D/S40P/S67N/C73R/A112V/A120V | 221 | 762 | 355 |
| N13D/F17I/S40P/T56M/R66S/S67N/G70C/A112V/A120V/R141S | 222 | 763 | 356 |
| S40P/F43L/R66S/S67N/G70A/A112V/R119L/A120V | 223 | 764 | 357 |
| V23G/S40T/G104A/A112V/R119L/A120V | 224 | 765 | 358 |
| W12R/F36I/N54Y/S67I/C73S/A93V/G104A/A112V/K115Q/R119W | 225 | 766 | 359 |
| S40P/M50L/S67I/C73S/R92G/A93V/A112V/A120V/R141S | 226 | 767 | 360 |
| F17I/T25A/S40P/F43Y/S67N/C73R/F86Y/A112V/R119W/T125I | 227 | 768 | 361 |
| F17I/S40P/M50L/S67I/C73S/A112V/A120V/E130K/P136L | 228 | 769 | 362 |
| W12R/S40P/S67N/C73R/A93V/A112V/A120V/R141S | 229 | 770 | 363 |
| F17I/S40P/M50L/S67I/C73S/R92G/A93V/A112V/A120V/R141S | 230 | 771 | 364 |
| F17I/S40P/M50L/S67I/A112V/A120V/R141S | 231 | 772 | 365 |
| V23G/T56P/S67I/C73S/F86Y/R92G/G104A/A112V/R119W/A143D | 232 | 773 | 366 |
| F17I/S40P/M50L/S67I/C73S/R92G/A93V/A112V/R119W/T125I | 233 | 774 | 367 |
| D9V/P11A/N13D/S40T/T56M/S67N/R95L/G104A/A112V/R119L/A120V | 234 | 775 | 368 |
| F17I/T25A/S40P/F43Y/S67N/A112V/R119L/A120V | 235 | 776 | 369 |
| D9E/F17I/S40P/M50L/S67I/C73S/V90M/T100A/G104A/K111M/A112V/R119W/A120V/A143D | 236 | 777 | 370 |
| F17I/S40P/M50L/S67I/C73S/R92G/A93V/A112V/A120V/R141G | 237 | 771 | 371 |
| F17I/S40P/S67N/S89G/R95L/A112V/R119W/T125I | 238 | 779 | 373 |
| F17I/S40P/M50L/S67I/C73S/R92G/A93V/K111M/A112V/R119Q/A120V | 239 | 780 | 372 |
| D9N/F17I/T31N/S40P/M50L/S67I/C73S/R92G/A93V/A112V/A120V/R141S | 240 | 658 | 373 |
| N13D/S40T/T56M/S67N/R95L/G104A/K111R/A112V/A120V/T125I | 241 | 673 | 374 |
| W12G/F17I/S40P/M50L/A112V/P132T | 242 | 683 | 375 |
| D9N/F17I/S40P/M50T/T56A/G70S/C73R/R92G/A93V/A112V/A120V/R141 | 243 | 713 | 328 |
| N38S/L59M/Q71L/S107T/A112V/K115E/R119Q/A120V | 490 | 393 | 549 |
| M50V/L59M/A112V/R119Q/A120V | 491 | 394 | 550 |
| P81S/F86Y/R92S/S107T/A112V/K115E/A120V | 492 | 395 | 551 |
| C73R/R84Q/F86Y/S107T/A112V/K115D/A120V | 493 | 396 | 552 |
| W12G/M50T/S53N/S67R/G70S/C73R/G104V/A112V/K115E/R119W | 494 | 397 | 553 |
| T31I/F36Y/F43Y/S67N/G70S/C73R/V90M/A112V/R119W | 495 | 398 | 554 |
| R76S/S107T/K111N/A112V/K115N/A120V | 496 | 399 | 555 |
| F86Y/A112V/R119W/A120V | 497 | 400 | 556 |
| N13S/M50I/R76S/S107T/A112V/K115N/R119W/A120V | 498 | 401 | 557 |
| P14H/T16S/M50L/C73R/R84Q/F86Y/S107T/A112V/K115E/A120V | 499 | 402 | 558 |
| F17L/T25A/L59M/E64K/F86Y/R94Q/S107T/A112V/K115N/R119W/A120V | 500 | 403 | 559 |
| Q71R/F86Y/A112V/K115E/R119Q/A120V | 501 | 404 | 560 |

TABLE 1-continued

Exemplary variant PD-1 polypeptides

| Mutation(s) | SEQ ID NO ECD (1-150) | SEQ ID NO IgV (6-127) | SEQ ID NO IgV (15-125) |
|---|---|---|---|
| R76S/S107T/A112V/K115N/R119W/A120V | 502 | 405 | 561 |
| M50I/A112V/K115D/A120V | 503 | 406 | 562 |
| M50V/P81S/F86Y/R92S/S107T/A112V/K115E/A120V | 504 | 407 | 563 |
| M50I/S67N/G70R/K111T/A112V/R119W/A120V | 505 | 408 | 564 |
| P14H/T16S/M50L/L80Q/K111M/R119Q/A120V | 506 | 409 | 565 |
| T31I/F36Y/E64K/A112V/K115E/R119Q/A120V | 507 | 410 | 566 |
| S107T/A112V/R119W/A120V | 508 | 411 | 567 |
| T56S/A112V/K115E/A120V | 509 | 412 | 568 |
| T56S/A112V/R119W | 510 | 413 | 569 |
| T56S | 511 | 414 | 570 |
| N46I/Y48N/D57Y/S67C/V90L/A112V | 512 | 415 | 571 |
| T56S/A112V/R119P | 513 | 416 | 572 |
| P14H/F17I/V44M/A112V/K115E/A120V | 514 | 417 | 573 |
| N38S/T56S/A112V/K115E/A120V | 515 | 418 | 574 |
| S42G/M50L/P69S/F86Y/A112V/K115E | 516 | 419 | 575 |
| P14H/T56S/A112V/K115E/A120V | 517 | 420 | 568 |
| N13S/S67N/G70C/F86Y/S89N/V91D/A112V/R119L/A120V | 518 | 421 | 576 |
| W12G/S67N/Q71R/F86Y/K111M/A112V/K115Q/R119W | 519 | 422 | 577 |
| S67N/C73R/V91D/S107T/K111M/A112V/K115Q/R119W | 520 | 423 | 578 |
| N13S/M50I/R76S/S107T/K111M/A112V/K115Q/R119W | 521 | 424 | 579 |
| T33I/S67N/G70S/S107T/K111N/A112V/K115E/R119W | 522 | 425 | 580 |
| P69L/F86Y/V90M/T100I/S107T/K111N/A112V/K115N/A120V | 523 | 426 | 581 |
| F17L/T25A/P69L/F86Y/V90M/T100I/S107T/K111N/A112V/K115N/A120V | 524 | 427 | 582 |
| T33I/M50I/R76S/F86Y/S107T/A112V/K115N/R119W/A120V | 525 | 428 | 583 |
| N13S/S67N/C73R/F86Y/S107T/A112V/Q113R/K115E/A120V | 526 | 429 | 584 |
| S67N/C73R/F86Y/V91D/S107T/A112V/K115D/A120V | 527 | 430 | 585 |
| F17L/T25A/S67N/C73R/R84Q/F86Y/A93V/A112V/K115E/R119W | 528 | 431 | 586 |
| T56S/A112V/K115E | 529 | 432 | 587 |
| P69L/V91D/A112V/K115N/R119W/A120V | 530 | 433 | 588 |
| N13S/E41D/M50I/G70V/D72N/F86Y/R94Q/A112V/R119L/A120V | 531 | 434 | 589 |
| M50I/P69L/F86Y/V90M/T100I/S107T/K111N/A112V/K115N/A120V | 532 | 435 | 590 |
| M50I/C73R/S107T/K111N/A112V/K115N/A120V | 533 | 436 | 591 |
| F86Y/A112V/K115N/R119W | 534 | 437 | 592 |
| M50I/S67N/C73R/F86Y/R95L/S107T/A112V/K115N/R119W | 535 | 438 | 593 |
| M50L/Q68R/P69S/F86Y/S107T/A112V/K115N/R119W | 536 | 439 | 594 |
| N38T/A112V/K115N/R119L/A120V | 537 | 440 | 595 |
| S67N/Q71H/F86Y/R95L/S107T/A112V/K115N/R119W | 538 | 441 | 596 |
| A20T/D28E/F36L/M50I/Q68R/P69S/F86Y/A112V/R119L/A120V | 539 | 442 | 597 |
| M50I/S67N/C73R/F86Y/R95L/A112V/Q113W/R119L/A120V | 540 | 443 | 598 |
| L59M/S67N/Q71L/C73R/R95L/S107T/A112V/K115N/R119W | 541 | 444 | 599 |
| P52L/S53N/C73S/A112V/E116D/R119W | 542 | 445 | 600 |
| Q71R/C73R/A112V/K115N/R119W/A120V | 543 | 446 | 601 |
| W12L/A20T/N29D/S37P/L59M/Q68R/P69S/F86Y/A112V/R119L/A120V | 544 | 447 | 602 |
| N46I/Y48F/D57V/P69L/A112V/K115N/R119W | 545 | 448 | 603 |
| M50I/S67N/C73R/F86Y/R95L/S107T/A112V/K115Q/R119Q/A120V | 546 | 449 | 604 |
| N54D/P69H/C73R/F86Y/R95L/S107T/A112V/K115N/R119W | 547 | 450 | 605 |
| T56S/Q71K/F86Y/R95L/S107T/A112V/K115N/R119W | 548 | 451 | 606 |
| C73A/F86Y/S107T/A112V/K115N/R119Q/A120V | 869 | 811 | 927 |
| C73R/F86Y/A105G/S107T/A112V/K115N/R119L/A120V | 870 | 812 | 928 |
| N54H/G70E/C73P/F86Y/A112V/K115D/R119L/A120V | 871 | 813 | 929 |
| C73G/F86Y/S107T/A112V/K115N/R119Q/A120V | 872 | 814 | 930 |
| N54S/C73G/F86Y/S107T/A112V/K115D/R119L/A120V | 873 | 815 | 931 |
| F86Y/S107T/A112V/K115D/R119W/A120V | 874 | 816 | 932 |
| G70E/C73P/F86Y/S107T/A112V/K115E/R119Q/A120V | 875 | 817 | 933 |
| C73G/A105G/S107T/A112V/K115D/R119W | 876 | 818 | 934 |
| C73G/F86Y/S107T/A112V/K115D/R119L/A120V | 877 | 819 | 935 |
| C73S/F86Y/S107T/A112V/K115D/R119L/A120V | 878 | 820 | 936 |
| L45V/C73G/F86Y/G104A/S107T/A112V/K115N/R119W/A120V | 879 | 821 | 937 |
| C73P/F86Y/S107T/A112V/K115D/R119Q/A120V | 880 | 822 | 938 |
| C73S/F86Y/S107T/A112V/K115E/R119Q/A120V | 881 | 823 | 939 |
| C73S/F86Y/G104T/S107T/A112V/K115E/R119W/A120V | 882 | 824 | 940 |
| C73R/F86Y/S107T/K111R/A112V/K115D/A120V | 883 | 825 | 941 |
| P14L/C73G/F86Y/S107T/A112V/K115D/R119L/A120V | 884 | 826 | 935 |
| G70E/F86Y/S107T/A112V/K115D/R119L/A120V | 885 | 827 | 943 |
| C73G/F86Y/G104V/S107T/A112V/K115N/R119L/A120V | 886 | 828 | 944 |
| C73S/F86Y/G104S/S107T/L108F/A112V/K115D/R119L/A120V | 887 | 829 | 945 |
| C73S/F86Y/S107T/A112V/K115D/A120V | 888 | 830 | 946 |
| C73R/F86Y/S107T/A112V/K115D/R119L/A120V | 889 | 831 | 947 |
| C73S/F86Y/S107T/A112V/Q113R/K115D/R119L/A120V | 890 | 832 | 948 |
| C73S/F86Y/V91A/S107T/A112V/K115D/R119L/A120V | 891 | 833 | 949 |
| G70E/C73P/F86Y/A105G/S107T/A112V/K115D/R119Q/A120V | 892 | 834 | 950 |
| C73G/F86Y/A105G/S107T/A112V/K115D/R119L/A120V | 893 | 835 | 951 |
| C73G/F86Y/A105G/S107T/A112V/Q113R/K115D/R119L/A120V | 894 | 836 | 952 |

TABLE 1-continued

Exemplary variant PD-1 polypeptides

| | SEQ ID NO | | |
|---|---|---|---|
| Mutation(s) | ECD (1-150) | IgV (6-127) | IgV (15-125) |
| F86Y/S107T/A112V/K115D/R119Q/A120V | 895 | 837 | 953 |
| C73R/F86Y/S107T/A112V/K115N/R119L/A120V | 896 | 838 | 954 |
| C73A/F86Y/S107T/A112V/Q113R/K115E/R119Q/A120V | 897 | 839 | 955 |
| C73R/F86Y/S107T/A112V/K115D/R119Q/A120V | 898 | 840 | 956 |
| C73G/F86Y/A112V/K115D/R119W/A120V | 899 | 841 | 957 |
| C73P/F86Y/A105G/S107T/A112V/Q113R/K115D/R119L/A120V | 900 | 842 | 958 |
| C73R/F86Y/A105G/S107T/A112V/K115D/R119L/A120V | 901 | 843 | 959 |
| C73A/F86Y/S107T/A112V/K115D/R119L/A120V | 902 | 844 | 960 |
| P69S/C73R/F86Y/S107T/A112V/K115D/R119W/A120V | 903 | 845 | 961 |
| C73S/F86Y/G104S/S107T/A112V/K115E/R119W/A120V | 904 | 846 | 962 |
| Q68R/C73S/F86Y/S107T/A112V/K115D/R119Q/A120V | 905 | 847 | 963 |
| C73R/F86Y/S107T/A112V/K115N/R119Q/A120V | 906 | 848 | 964 |
| G70E/C73R/F86Y/S107T/A112V/K115N/R119Q/A120V | 907 | 849 | 965 |
| C73S/F86Y/S107T/A112V/K115D/R119W/A120V | 908 | 850 | 966 |
| G70E/F86Y/G104T/I106L/S107T/L108T/A112V/K115N/R119L/A120V | 909 | 851 | 967 |
| C73H/F86Y/A105G/S107T/A112V/K115D/R119L/A120V | 910 | 852 | 968 |
| G70E/C73P/F86Y/A105C/S107T/A112V/K115D/R119L/A120V | 911 | 853 | 969 |
| G70E/C73P/F86Y/S107T/A112V/K115D/R119Q/A120V | 912 | 854 | 970 |
| C73S/F86Y/S107T/K111R/A112V/K115E/R119L/A120V | 913 | 855 | 971 |
| C73R/D85G/F86Y/A105G/S107T/A112V/K115D/R119Q/A120V | 914 | 856 | 972 |
| C73R/F86Y/S107T/A112V/K115E/R119W/A120V | 915 | 857 | 973 |
| N54S/C73G/F86Y/S107T/A112V/K115E/R119Q/A120V | 916 | 858 | 974 |
| C73S/F86Y/G104S/S107T/A112V/K115N/R119L/A120V | 917 | 859 | 975 |
| F17L/Q71R/C73G/F86Y/A105G/S107T/A112V/K115D/R119L/A120V | 918 | 860 | 976 |
| C73G/F86Y/S107T/A112V/K115E/R119W/A120V | 919 | 861 | 977 |
| G70E/C73G/F86Y/A105C/S107T/A112V/K115E/R119L/A120V | 920 | 862 | 978 |
| C73G/F86Y/G104A/S107T/A112V/K115D/R119W/A120V | 921 | 863 | 979 |
| C73S/F86Y/S107T/A112V/K115N/A120V | 922 | 864 | 980 |
| C73P/F86Y/S107T/A112V/K115N/R119L/A120V | 923 | 865 | 981 |
| W12R/F86Y/S107T/A112V/K115D/R119Q/A120V | 924 | 866 | 953 |
| G70E/C73G/F86Y/A105L/A112V/K115N/R119Q/A120V | 925 | 867 | 942 |
| F86Y/S107T/A112V/K115N/R119W/A120V | 926 | 868 | 982 |

In some embodiments, any of the provided variant PD-1 polypeptides can further contain an amino acid substitution at position 59, 60, or 73 with reference to positions set forth in SEQ ID NO:37. In some examples, the amino acid substitution is one or more of C73A, C73R, C73S, L59C, and/or A60C with reference to numbering of positions set forth in SEQ ID NO:37. In some embodiments, the variant PD-1 polypeptide contains amino acid substitutions F17I/S40P/T56S/L59C/A112V, W12R/L59C/R66H/F86YN90L/A112V/K115N/R119L/A120V, S40P/L59C/A112V/R119W, V44H/L45V/N46I/Y48H/M50E/N54G/K58T/A60C/L102V/A105V/A112I, Exemplary variant PD-1 polypeptides are set forth in SEQ ID NOs: 462-470, 645, and 646.

In some embodiments, any of the provided variants of PD-1 can be included as a polypeptide that is shorter or longer as described, such as by 1-15 amino acids, e.g. 1, 2, 3, 4, 5, 6, 7, 8 or 9 amino acids longer or shorter, than the sequence of amino acids set forth in Table 1 as long as the PD-1 polypeptide binds to PD-L1, including binding with increased affinity compared to the wild-type or unmodified PD-1 polypeptide. In some embodiments, the variant PD-1 polypeptide is a PD-1 IgV containing residues corresponding to amino acids 13-127 of the ECD as set forth in SEQ ID NO: 37, designated "PD-1 (13-127)". Exemplary PD-1 (13-127) polypeptides are set forth in SEQ ID NOs: 457-461.

In some embodiments, the variant PD-1 polypeptide exhibits increased affinity for the ectodomain of PD-L1 compared to the wild-type or unmodified PD-1 polypeptide, such as compared to the sequence set forth in SEQ ID NO: 37, 244, 392, or 457. In some embodiments, the PD-1 polypeptide exhibits increased affinity for the ectodomain of PD-L2 compared to the wild-type or unmodified PD-1, such as compared to the sequence set forth in SEQ ID NO: 37, 244, 392, or 457. In some embodiments, the PD-1 polypeptide exhibits increased affinity for the ectodomain of PD-L1 and the ectodomain of PD-L2 compared to the wild-type or unmodified PD-1, such as compared to the sequence set forth in SEQ ID NO: 37, 244, 392, or 457.

In some embodiments, the variant PD-1 polypeptide exhibits increased binding affinity for binding one of the ectodomains of PD-L1 or PD-L2 and exhibits decreased binding affinity for binding to the other of the ectodomains of PD-L1 or PD-L2 compared to the wild-type or unmodified PD-1 polypeptide, such as compared to the sequence set forth in SEQ ID NO: 37, 244, 392, or 457. In some embodiments, the variant PD-1 polypeptide exhibits increased affinity for the ectodomain of PD-L1, and decreased affinity for the ectodomain of PD-L2, compared to wild-type or unmodified PD-1 polypeptide, such as compared to the sequence set forth in SEQ ID NO: 37, 244, 392, or 457. In some embodiments, the variant PD-1 polypeptide exhibits increased affinity for the ectodomain of PD-L2 and decreased affinity for the ectodomain of PD-L1, compared to wild-type or unmodified PD-1 polypeptide, such as compared to the sequence set forth in SEQ ID NO: 37, 244, 392, or 457.

In some embodiments, a variant PD-1 polypeptide exhibits increased selectivity for PD-L1 versus PD-L2 compared to the unmodified PD-1 polypeptide (e.g. set forth in SEQ ID NO: 37, 244, 392, or 457) for binding PD-L1 versus PD-L2, such as indicated by a ratio of PD-L1 binding to PD-L2 binding (PD-L1:PD-L2 binding ratio). In some embodiments, the ratio of binding is greater than 1. In some embodiments, the variant PD-1 polypeptide exhibits a ratio of binding PD-L1 versus PD-L2 that is greater than or greater than about or 1.1, 1.2, 1.3, 1.4, 1.5, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, or more.

III. FORMAT OF VARIANT POLYPEPTIDES

The immunomodulatory polypeptide comprising a variant PD-1 provided herein in which is contained a vIgD can be formatted in a variety of ways, including as a soluble protein, membrane bound protein or secreted protein. In some embodiments, the particular format can be chosen for the desired therapeutic application. In some cases, an immunomodulatory polypeptide comprising a variant PD-1 polypeptide is provided in a format to block activity associated with the PD-L1/PD-1 negative regulatory complex. In some embodiments, activity to block PD-L1/PD-1 negative regulatory complex may be useful to promote immunity in oncology. Exemplary methods for assessing such activities are provided herein, including in the examples.

In some aspects, provided are immunomodulatory proteins comprising a vIgD of PD-1 in which such proteins are soluble, such as polypeptides that lack a transmembrane domain or are not capable of being expressed on the surface of a cell. In some cases, such proteins include those in which a vIgD of PD-1 provided herein is linked directly or indirectly to a multimerization domain, such as an Fc domain. Provided herein are variant PD-1-Fc fusion proteins.

In some embodiments, the immunomodulatory polypeptide comprising a variant PD-1 can include one or more vIgD of PD-1 provided herein. In some embodiments, a variant PD-1 immunomodulatory protein provided herein will comprise exactly 1, 2, 3, 4, 5 or more variant PD-1 sequences. In some embodiments, at least two variant PD-1 sequences are identical variant IgSF domains. In some embodiments, the provided immunomodulatory polypeptide comprises two or more vIgD sequences of PD-1. Multiple variant PD-1 within the polypeptide chain can be identical (i.e., the same species) to each other or be non-identical (i.e., different species) variant PD-1 sequences. In addition to single polypeptide chain embodiments, in some embodiments two, three, four, or more of the polypeptides of the invention can be covalently or non-covalently attached to each other. Thus, monomeric, dimeric, and higher order (e.g., 3, 4, 5, or more) multimeric proteins are provided herein. For example, in some embodiments exactly two polypeptides of the invention can be covalently or non-covalently attached to each other to form a dimer. In some embodiments, attachment is made via interchain cysteine disulfide bonds. Compositions comprising two or more polypeptides of the invention can be of an identical species or substantially identical species of polypeptide (e.g., a homodimer) or of non-identical species of polypeptides (e.g., a heterodimer). A composition having a plurality of linked polypeptides of the invention can, as noted above, have one or more identical or non-identical variant PD-1 of the invention in each polypeptide chain. In some specific embodiments, identical or substantially identical species (allowing for 3 or fewer N-terminus or C-terminus amino acid sequence differences) of PD-1-Fc variant fusion polypeptides will be dimerized to create a homodimer. Alternatively, different species of PD-1-Fc variant fusion polypeptides can be dimerized to yield a heterodimer.

In some aspects, one or more additional IgSF domain, such as one or more additional vIgD, may be linked to a vIgD of PD-1 as provided herein (hereinafter called a "stack" or "stacked" immunomodulatory protein). In some embodiments, the modular format of the provided immunomodulatory proteins provides flexibility for engineering or generating immunomodulatory proteins for modulating activity of multiple counterstrucutres (multiple cognate binding partners). In some embodiments, such "stack" molecules can be provided in a soluble format or, in some cases, may be provided as membrane bound or secreted proteins.

In some embodiments, a variant PD-1 immunomodulatory protein is provided as a conjugate in which is contained a vIgD of PD-1 linked, directly or indirectly, to a targeting agent or moiety, e.g. to an antibody or other binding molecules that specifically binds to a ligand, e.g. an antigen, for example, for targeting or localizing the vIgD to a specific environment or cell, such as when administered to a subject. In some embodiments, the targeting agent, e.g. antibody or other binding molecule, binds to a tumor antigen, thereby localizing the variant PD-1 containing the vIgD to the tumor microenvironment, for example, to modulate activity of tumor infiltrating lymphocytes (TILs) specific to the tumor microenvironment. In some embodiments, the targeting agent, e.g. antibody or other binding molecule, binds to an antigen expressed on antigen presenting cells or cell or tissue in tumor microenvironment, thereby localizing the variant PD-1 containing the vIgD to target areas for activity.

In some embodiments, provided immunomodulatory proteins are expressed in cells and provided as part of an engineered cellular therapy (ECT). In some embodiments, the variant PD-1 polypeptide is expressed in a cell, such as an immune cell (e.g. T cell or antigen presenting cell), in membrane-bound form, thereby providing a transmembrane immunomodulatory protein (hereinafter also called a "TIP"). In some embodiments, depending on the cognate binding partner recognized by the TIP, engineered cells expressing a TIP can act as a decoy receptor to block activity associated with the PD-L1/PD-1 negative regulatory complex. In some aspects, the variant PD-1 polypeptide is expressed in a cell, such as an immune cell (e.g. T cell or antigen presenting cell), in secretable form to thereby produce a secreted or soluble form of the variant PD-1 polypeptide (hereinafter also called a "SIP"), such as when the cells are administered to a subject. In some aspects, a SIP can block the interactions associated with the PD-L1/PD-1 negative regulatory complex in the environment (e.g. tumor microenvironment) in which it is secreted. In some embodiments, a variant PD-1 polypeptide is expressed in an infectious agent (e.g. viral or bacterial agent) which, upon administration to a subject, is able to infect a cell in vivo, such as an immune cell (e.g. T cell or antigen presenting cell), for delivery or expression of the variant polypeptide as a TIP or a SIP in the cell.

In some embodiments, a soluble immunomodulatory polypeptide, such as a variant PD-1 containing a vIgD, can be encapsulated within a liposome which itself can be conjugated to any one of or any combination of the provided conjugates (e.g., a targeting moiety). In some embodiments, the soluble or membrane bound immunomodulatory polypeptides of the invention are deglycosylated. In more specific embodiments, the variant PD-1 sequence is deglycosylated. In even more specific embodiments, the IgV domain of the variant PD-1 is deglycosylated.

Non-limiting examples of provided formats are described in FIGS

A. Soluble Protein

In some embodiments, the immunomodulatory protein containing a variant PD-1 polypeptide is a soluble protein. Those of skill will appreciate that cell surface proteins typically have an intracellular, transmembrane, and extracellular domain (ECD) and that a soluble form of such proteins can be made using the extracellular domain or an immunologically active subsequence thereof. Thus, in some embodiments, the immunomodulatory protein containing a variant PD-1 polypeptide lacks a transmembrane domain or a portion of the transmembrane domain. In some embodiments, the immunomodulatory protein containing a variant PD-1 lacks the intracellular (cytoplasmic) domain or a portion of the intracellular domain. In some embodiments, the immunomodulatory protein containing the variant PD-1 polypeptide only contains the vIgD portion containing the ECD domain or a portion thereof containing an IgV domain or specific binding fragment thereof containing the amino acid modification(s).

In some embodiments, the immunomodulatory protein comprises a variant PD-1 polypeptide attached to an immunoglobulin Fc (yielding an "immunomodulatory Fc fusion," such as a "PD-1-Fc variant fusion," also termed a PD-1 vIgD-Fc fusion). In some embodiments, the attachment of the variant PD-1 polypeptide is at the N-terminus of the Fc. In some embodiments, the attachment of the variant PD-1 polypeptide is at the C-terminus of the Fc. In some embodiments, two or more PD-1 variant polypeptides (the same or different) are independently attached at the N-terminus and at the C-terminus.

In some embodiments, the Fc is murine or human Fc. In some embodiments, the Fc is a mammalian or human IgG1, IgG2, IgG3, or IgG4 Fc regions. In some embodiments, the Fc is derived from IgG1, such as human IgG1. In some embodiments, the Fc comprises the amino acid sequence set forth in SEQ ID NO:390 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 390.

In some embodiments, the Fc region contains one more modifications to alter (e.g. reduce) one or more of its normal functions. In general, the Fc region is responsible for effector functions, such as complement-dependent cytotoxicity (CDC) and antibody-dependent cell cytotoxicity (ADCC), in addition to the antigen-binding capacity, which is the main function of immunoglobulins. Additionally, the FcRn sequence present in the Fc region plays the role of regulating the IgG level in serum by increasing the in vivo half-life by conjugation to an in vivo FcRn receptor. In some embodiments, such functions can be reduced or altered in an Fc for use with the provided Fc fusion proteins.

In some embodiments, one or more amino acid modifications may be introduced into the Fc region of a PD-1-Fc variant fusion provided herein, thereby generating an Fc region variant. In some embodiments, the Fc region variant has decreased effector function. There are many examples of changes or mutations to Fc sequences that can alter effector function. For example, WO 00/42072, WO2006019447, WO2012125850, WO2015/107026, US2016/0017041 and Shields et al. *J Biol. Chem.* 9(2): 6591-6604 (2001) describe exemplary Fc variants with improved or diminished binding to FcRs. The contents of those publications are specifically incorporated herein by reference.

In some embodiments, the provided variant PD-1-Fc fusions comprise an Fc region that exhibits reduced effector functions, which makes it a desirable candidate for applications in which the half-life of the PD-1-Fc variant fusion in vivo is important yet certain effector functions (such as CDC and ADCC) are unnecessary or deleterious. In vitro and/or in vivo cytotoxicity assays can be conducted to confirm the reduction/depletion of CDC and/or ADCC activities. For example, Fc receptor (FcR) binding assays can be conducted to ensure that the PD-1-Fc variant fusion lacks FcγR binding (hence likely lacking ADCC activity), but retains FcRn binding ability. The primary cells for mediating ADCC, NK cells, express FcγRIII only, whereas monocytes express FcγR1, FcγRII and FcγRIII. FcR expression on hematopoietic cells is summarized in Table 2 on page 464 of Ravetch and Kinet, *Annu. Rev. Immunol.* 9:457-492 (1991). Non-limiting examples of in vitro assays to assess ADCC activity of a molecule of interest is described in U.S. Pat. No. 5,500,362 (see, e.g. Hellstrom, I. et al. *Proc. Nat'l Acad. Sci. USA* 83:7059-7063 (1986)) and Hellstrom, I et al., *Proc. Nat'l Acad. Sci. USA* 82:1499-1502 (1985); U.S. Pat. No. 5,821,337 (see Bruggemann, M. et al., *J. Exp. Med.* 166:1351-1361 (1987)). Alternatively, non-radioactive assay methods may be employed (see, for example, ACTI™ non-radioactive cytotoxicity assay for flow cytometry (CellTechnology, Inc. Mountain View, Calif.; and CytoTox 96™ non-radioactive cytotoxicity assay (Promega, Madison, Wis.). Useful effector cells for such assays include peripheral blood mononuclear cells (PBMC) and Natural Killer (NK) cells. Alternatively, or additionally, ADCC activity of the molecule of interest may be assessed in vivo, e.g., in an animal model such as that disclosed in Clynes et al. *Proc. Nat'l Acad. Sci. USA* 95:652-656 (1998). C1q binding assays may also be carried out to confirm that the PD-1-Fc variant fusion is unable to bind C1q and hence lacks CDC activity. See, e.g., C1q and C3c binding ELISA in WO 2006/029879 and WO 2005/100402. To assess complement activation, a CDC assay may be performed (see, for example, Gazzano-Santoro et al., *J. Immunol. Methods* 202:163 (1996); Cragg, M. S. et al., *Blood* 101: 1045-1052 (2003); and Cragg, M. S. and M. J. Glennie, Blood 103:2738-2743 (2004)). FcRn binding and in vivo clearance/half life determinations can also be performed using methods known in the art (see, e.g., Petkova, S. B. et al., *Int'l. Immunol.* 18(12):1759-1769 (2006)).

PD-1-Fc variant fusions with reduced effector function include those with substitution of one or more of Fc region residues 238, 265, 269, 270, 297, 327 and 329 by EU numbering (U.S. Pat. No. 6,737,056). Such Fc mutants include Fc mutants with substitutions at two or more of amino acid positions 265, 269, 270, 297 and 327 by EU numbering, including the so-called "DANA" Fc mutant with substitution of residues 265 and 297 to alanine (U.S. Pat. No. 7,332,581).

In some embodiments, the Fc region of PD-1-Fc variant fusions has an Fc region in which any one or more of amino acids at positions 234, 235, 236, 237, 238, 239, 270, 297, 298, 325, and 329 (indicated by EU numbering) are substituted with different amino acids compared to the native Fc region. Such alterations of Fc region are not limited to the above-described alterations, and include, for example, alterations such as deglycosylated chains (N297A and N297Q), IgG1-N297G, IgG1-L234A/L235A, IgG1-L234A/L235E/G237A, IgG1-A325A/A330S/P331S, IgG1-C226S/C229S, IgG1-C226S/C229S/E233P/L234V/L235A, IgG1-E233P/L234V/L235A/G236del/S267K, IgG1-L234F/L235E/P331S, IgG1-S267E/L328F, IgG2-V234A/G237A, IgG2-H268QN309L/A330S/A331S, IgG4-L235A/G237A/E318A, and IgG4-L236E described in Current Opinion in Biotechnology (2009) 20 (6), 685-691; alterations such as G236R/L328R, L235G/G236R, N325A/L328R, and N325LL328R described in WO 2008/092117; amino acid insertions at positions 233, 234, 235, and 237 (indicated by EU numbering); and alterations at the sites described in WO 2000/042072.

Certain Fc variants with improved or diminished binding to FcRs are described. (See, e.g., U.S. Pat. No. 6,737,056; WO 2004/056312, WO2006019447 and Shields et al., *J. Biol. Chem.* 9(2): 6591-6604 (2001).)

In some embodiments, there is provided a PD-1-Fc variant fusion comprising a variant Fc region comprising one or more amino acid substitutions which increase half-life and/or improve binding to the neonatal Fc receptor (FcRn). Antibodies with increased half-lives and improved binding to FcRn are described in US2005/0014934A1 (Hinton et al.) or WO2015107026. Those antibodies comprise an Fc region with one or more substitutions therein which improve binding of the Fc region to FcRn. Such Fc variants include those with substitutions at one or more of Fc region residues: 238, 256, 265, 272, 286, 303, 305, 307, 311, 312, 317, 340, 356, 360, 362, 376, 378, 380, 382, 413, 424 or 434 by EU numbering, e.g., substitution of Fc region residue 434 (U.S. Pat. No. 7,371,826).

In some embodiments, the Fc region of a PD-1-Fc variant fusion comprises one or more amino acid substitution E356D and M358L by EU numbering. In some embodiments, the Fc region of a PD-1-Fc variant fusion comprises one or more amino acid substitutions C220S, C226S and/or C229S by EU numbering. In some embodiments, the Fc region of a PD-1 variant fusion comprises one or more amino acid substitutions R292C and V302C. See also Duncan & Winter, *Nature* 322:738-40 (1988); U.S. Pat. Nos. 5,648,260; 5,624,821; and WO 94/29351 concerning other examples of Fc region variants.

In some embodiments, alterations are made in the Fc region that result in diminished C1q binding and/or Complement Dependent Cytotoxicity (CDC), e.g., as described in U.S. Pat. No. 6,194,551, WO 99/51642, and Idusogie et al., *J. Immunol.* 164: 4178-4184 (2000).

In some embodiments, there is provided a PD-1-Fc variant fusion comprising a variant Fc region comprising one or more amino acid modifications, wherein the variant Fc region is derived from IgG1, such as human IgG1. In some embodiments, the variant Fc region is derived from the amino acid sequence set forth in SEQ ID NO: 390. In some embodiments, the Fc contains at least one amino acid substitution that is N82G by numbering of SEQ ID NO: 390 (corresponding to N297G by EU numbering). In some embodiments, the Fc further contains at least one amino acid substitution that is R77C or V87C by numbering of SEQ ID NO: 390 (corresponding to R292C or V302C by EU numbering). In some embodiments, the variant Fc region further comprises a C5S amino acid modification by numbering of SEQ ID NO: 390 (corresponding to C220S by EU numbering). For example, in some embodiments, the variant Fc region comprises the following amino acid modifications: V297G and one or more of the following amino acid modifications C220S, R292C or V302C by EU numbering (corresponding to N82G and one or more of the following amino acid modifications C5S, R77C or V87C with reference to SEQ ID NO:390), e.g., the Fc region comprises the sequence set forth in SEQ ID NO:386. In some embodiments, the variant Fc region comprises one or more of the amino acid modifications C220S, L234A, L235E or G237A, e.g., the Fc region comprises the sequence set forth in SEQ ID NO:387. In some embodiments, the variant Fc region comprises one or more of the amino acid modifications C220S, L235P, L234V, L235A, G236del or S267K, e.g., the Fc region comprises the sequence set forth in SEQ ID NO:388. In some embodiments, the variant Fc comprises one or more of the amino acid modifications C220S, L234A, L235E, G237A, E356D or M358L, e.g., the Fc region comprises the sequence set forth in SEQ ID NO:384.

In some embodiments, the Fc region lacks the C-terminal lysine corresponding to position 232 of the wild-type or unmodified Fc set forth in SEQ ID NO: 390 (corresponding to K447del by EU numbering). In some aspects, such an Fc region can additionally include one or more additional modifications, e.g., amino acid substitutions, such as any as described. Exemplary of such an Fc region is set forth in SEQ ID NO: 476, 376-378.

In some embodiments, there is provided a PD-1-Fc variant fusion comprising a variant Fc region in which the variant Fc comprises the sequence of amino acids set forth in any of SEQ ID NOS:384, 386, 387, 388, 476, or 376-378, or a sequence of amino acids that exhibits at least 85%, 86%, 87%, 88%, 89%, 90%, 91%, 92%, 93%, 94%, 95%, 96%, 97%, 98%, 99% or more sequence identity to any of SEQ ID NOS: 384, 386, 387, 388, 476, or 376-378.

In some embodiments, the Fc domain is a human IgG1 that contains one or more amino acid substitutions E233P, L234A, L234V, L235A, L235E, G236del, G237A, S267K, or N297G, each numbered according to EU index by Kabat. In some embodiments, the Fc domain contains amino acid substitutions R292C/N297G/V302C. In some embodiments, the Fc domain contains amino acid substitutions L234A/L235E/G237A. In some aspects, the Fc domain can further contain an amino acid substitution C220S. In some aspects, the Fc domain can further contain the amino acid modification K447del. the Fc region comprises the sequence of amino acids set forth in SEQ ID NO:384 or 476, or a sequence of amino acids that exhibits at least 85%, 86%, 87%, 88%, 89%, 90%, 91%, 92%, 93%, 94%, 95%, 96%, 97%, 98% or 99% sequence identity to SEQ ID NO:384 or 476, and contains the amino acid substitutions therein and/or exhibits reduced effector function.

In some embodiments, the Fc is derived from IgG2, such as human IgG2. In some embodiments, the Fc comprises the amino acid sequence set forth in SEQ ID NO: 391 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 391.

In some embodiments, the Fc comprises the amino acid sequence set forth in SEQ ID NO: 379 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 379. In some embodiments, the IgG4 Fc is a stabilized Fc in which the CH3 domain of human IgG4 is substituted with the CH3 domain of human IgG1 and which exhibits inhibited aggregate formation, an antibody in which the CH3 and CH2 domains of human IgG4 are substituted with the CH3 and CH2 domains of human IgG1, respectively, or an antibody in which arginine at position 409 indicated in the EU index proposed by Kabat et al. of human IgG4 is substituted with lysine and which exhibits inhibited aggregate formation (see e.g. U.S. Pat. No. 8,911,726. In some embodiments, the Fc is an IgG4 containing the S228P mutation, which has been shown to prevent recombination between a therapeutic antibody and an endogenous IgG4 by Fab-arm exchange (see e.g. Labrijin et al. (2009) Nat. Biotechnol., 27(8): 767-71.) In some embodiments, the Fc comprises the amino acid sequence set forth in SEQ ID NO: 380 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 380.

In some embodiments, the variant PD-1 polypeptide is directly linked to the Fc sequence. In some embodiments, the variant PD-1 polypeptide is indirectly linked to the Fc sequence, such as via a linker. In some embodiments, one or more "peptide linkers" link the variant PD-1 polypeptide and the Fc domain. In some embodiments, a peptide linker can be a single amino acid residue or greater in length. In some embodiments, the peptide linker has at least one amino acid residue but is no more than 20, 19, 18, 17, 16, 15, 14, 13, 12, 11, 10, 9, 8, 7, 6, 5, 4, 3, 2, or 1 amino acid residues in length. In some embodiments, the linker is three alanines (AAA). In some embodiments, the linker is a flexible linker. In some embodiments, the linker is (in one-letter amino acid code): GGGGS ("4GS"; SEQ ID NO: 472) or multimers of the 4GS linker, such as repeats of 2, 3, 4, or 5 4GS linkers, such as set forth in SEQ ID NO: 474 (2×GGGGS) or SEQ ID NO: 473 (3×GGGGS). In some embodiments, the linker (in one-letter amino acid code) is GSGGGGS (SEQ ID NO:471). In some embodiments, the linker also can include a series of alanine residues alone or in addition to another peptide linker (such as a 4GS linker or multimer thereof). In some embodiments, the number of alanine residues in each series is: 2, 3, 4, 5, or 6 alanines. In some embodiments, the linker is a rigid linker. For example, the linker is an α-helical linker. In some embodiments, the linker is (in one-letter amino acid code): EAAAK or multimers of the EAAAK linker, such as repeats of 2, 3, 4, or 5 EAAAK linkers, such as set forth in SEQ ID NO: 634 (1×EAAAK), SEQ ID NO: 635 (3×EAAAK) or SEQ ID NO: 636 (5×EAAAK). In some embodiments, the linker can further include amino acids introduced by cloning and/or from a restriction site, for example the linker can include the amino acids GS (in one-letter amino acid code) as introduced by use of the restriction site BAMHI. For example, in some embodiments, the linker (in one-letter amino acid code) is GSGGGGS (SEQ ID NO:471), GS($G_4S$)$_3$ (SEQ ID NO: 643), or GS($G_4S$)$_5$ (SEQ ID NO: 644). In some examples, the linker is a 2×GGGGS followed by three alanines (GGGGSGGGGSAAA; SEQ ID NO: 475). In some cases, the immunomodulatory polypeptide comprising a variant PD-1 comprises various combinations of peptide linkers.

In some embodiments, the variant PD-1-Fc fusion protein is a dimer formed by two variant PD-1 Fc polypeptides linked to an Fc domain. In some embodiments, the dimer is a homodimer in which the two variant PD-1 Fc polypeptides are the same. In some embodiments, the dimer is a heterodimer in which the two variant PD-1 Fc polypeptides are different.

Also provided are nucleic acid molecules encoding the variant PD-1-Fc fusion protein. In some embodiments, for production of an Fc fusion protein, a nucleic acid molecule encoding a variant PD-1-Fc fusion protein is inserted into an appropriate expression vector. The resulting variant PD-1-Fc fusion protein can be expressed in host cells transformed with the expression where assembly between Fc domains occurs by interchain disulfide bonds formed between the Fc moieties to yield dimeric, such as divalent, variant PD-1-Fc fusion proteins.

The resulting Fc fusion proteins can be easily purified by affinity chromatography over Protein A or Protein G columns. For the generation of heterodimers, additional steps for purification can be necessary. For example, where two nucleic acids encoding different variant PD-1 polypeptides are transformed into cells, the formation of heterodimers must be biochemically achieved since variant PD-1 molecules carrying the Fc-domain will be expressed as disulfide-linked homodimers as well. Thus, homodimers can be reduced under conditions that favor the disruption of interchain disulfides, but do not effect intra-chain disulfides. In some cases, different variant-PD-1 Fc monomers are mixed in equimolar amounts and oxidized to form a mixture of homo- and heterodimers. The components of this mixture are separated by chromatographic techniques. Alternatively, the formation of this type of heterodimer can be biased by genetically engineering and expressing Fc fusion molecules that contain a variant PD-1 polypeptide using knob-into-hole methods described below.

Also provided are immunomodulatory proteins containing a variant PD-1 polypeptide that is monovalent. In some embodiments, the variant monovalent polypeptide of the monovalent immunomodulatory protein is linked, directly or indirectly, to a further moiety. In some embodiments, the further moiety is a protein, peptide, small molecule or nucleic acid. In some embodiments, the monovalent immunomodulatory protein is a fusion protein. In some embodiments, the moiety is a half-life extending molecule. Exemplary of such half-life extending molecules include, but are not limited to, albumin, an albumin-binding polypeptide, Pro/Ala/Ser (PAS), a C-terminal peptide (CTP) of the beta subunit of human chorionic gonadotropin, polyethylene glycol (PEG), long unstructured hydrophilic sequences of amino acids (XTEN), hydroxyethyl starch (HES), an albumin-binding small molecule, or a combination thereof.

In some embodiments, the immunomodulatory polypeptide comprising a variant PD-1 can include conformationally disordered polypeptide sequences composed of the amino acids Pro, Ala, and Ser (See e.g., WO2008/155134, SEQ ID NO: 637). In some cases, the amino acid repeat is at least 3, 4, 5, 6, 7, 8, 9, 10, 11, 12, 13, 14, 15, 16, 17, 18, 19, 20, 21, 22, 23, 24, 25, 26, 27, 28, 29, 30 or more amino acid residues, wherein each repeat comprises (an) Ala, Ser, and Pro residue(s). Thus, provided herein is an immunomodulatory protein is a PASylated protein wherein the variant PD-1 polypeptide is linked, directly or indirectly via a linker, to Pro/Ala/Ser (PAS). In some embodiments, one or more additional linker structures may be used.

In some embodiments, the moiety facilitates detection or purification of the variant PD-1 polypeptide. In some cases, the immunomodulatory polypeptide comprises a tag or fusion domain, e.g. affinity or purification tag, linked, directly or indirectly, to the N- and/or c-terminus of the PD-1 polypeptide. Various suitable polypeptide tags and/or fusion domains are known, and include but are not limited to, a poly-histidine (His) tag, a FLAG-tag (SEQ ID NO: 639), a Myc-tag, and fluorescent protein-tags (e.g., EGFP, set forth in SEQ ID NOs: 628, 641, 642). In some cases, the immunomodulatory polypeptide comprising a variant PD-1 comprises at least six histidine residues (set forth in SEQ ID NO: 640). In some cases, the immunomodulatory polypeptide comprising a variant PD-1 further comprises various combinations of moieties. For example, the immunomodulatory polypeptide comprising a variant PD-1 further comprises one or more polyhistidine-tag and FLAG tag.

B. Stack Molecules with Additional IgSF Domains

Provided herein are immunomodulatory proteins that can contain a wild-type or variant PD-1 polypeptides linked, directly or indirectly, to one or more other immunoglobulin superfamily (IgSF) domain ("stacked" immunomodulatory protein construct and also called a "Type II" immunomodulatory protein). In some aspects, this can create unique multi-domain immunomodulatory proteins that bind two or more, such as three or more, cognate binding partners, thereby providing a multi-targeting modulation of the immune synapse.

In some embodiments, an immunomodulatory protein comprises a combination and/or arrangement of a wild-type PD-1 domain (e.g. IgV or a specific binding fragment thereof) with one or more other affinity modified and/or non-affinity modified IgSF domain sequences (e.g. IgV or specific binding fragment thereof) of another IgSF family member (e.g. a mammalian IgSF family member). In some embodiments, an immunomodulatory protein comprises a combination (a "non-wild-type combination") and/or arrangement (a "non-wild type arrangement" or "non-wild-type permutation") of a variant PD-1 domain with one or more other affinity modified and/or non-affinity modified IgSF domain sequences of another IgSF family member (e.g. a mammalian IgSF family member) that are not found in wild-type IgSF family members. In some embodiments, the immunomodulatory protein contains 2, 3, 4, 5 or 6 immunoglobulin superfamily (IgSF) domains, where at least one of the IgSF domain is a variant or wild-type PD-1 IgSF domain (vIgD of PD-1) according to the provided description.

In some embodiments, the immunomodulatory protein is or contains a variant PD-1 IgSF domain (e.g. IgV or a specific binding fragment thereof) that contains one or more amino acid modifications (e.g. amino acid substitutions, insertions or deletions) in a wild-type or unmodified PD-1 domain. In some embodiments, the unmodified PD-1 polypeptide has 85%, 85%, 87%, 88%, 89%, 90%, 91%, 92%, 93%, 94%, 95%, 96%, 97%, 98%, 99% sequence identity to SEQ ID NO: 37, 244, 392, or 457, or a specific binding fragment thereof. In some embodiments, the unmodified PD-1 polypeptide has the sequence set forth in any of SEQ ID NOs: 37, 244, 392, and 457.

In some aspects, the variant PD-1 exhibits specific binding to PD-L1 or PD-L2. In some embodiments, the variant PD-1 exhibits increased binding affinity to PD-L1 compared to the wild-type or unmodified PD-1. In some aspects, the binding affinity is increased at least 1.2-fold, 1.5-fold, 2.0-fold, 3.0-fold, 4.0-fold, 5.0-fold, 6.0-fold, 7.0-fold, 8.0-fold, 9.0-fold, 10.0-fold, 20.0-fold, 30.0-fold, 40.0-fold, 50.0-fold or more. In some embodiments, the variant PD-1 exhibits increased selectivity for PD-L1 compared to PD-L2, such as a greater ratio of binding for PD-L1 compared to PD-L2 than the ratio of binding of the unmodified or wild-type PD-1 for binding to PD-L1 compared to PD-L2. In some aspects, the ratio is greater than 1.0, such as is or is greater than 1.5-fold, 2.0-fold, 3.0-fold, 4.0-fold, 5.0-fold, 6.0-fold, 7.0-fold, 8.0-fold, 9.0-fold, 10.0-fold or more.

In some embodiments, the variant PD-1 polypeptide has one or more amino acid substitutions selected from P8T, D9E, D9G, D9N, D9V, P11A, W12G, W12L, W12R, N13D, N13S, N13Y, P14H, P14L, P14S, T16A, T16I, T16S, F17I, F17L, F17V, F17Y, S18T, A20S, A20T, A20V, L21V, L22I, V23E, V23G, V24L, T25A, D28E, N29D, N29S, A30V, T31I, T31N, T31S, T33I, C34Y, S35N, F36I, F36L, F36Y, S37P, S37T, N38D, N38S, N38T, T39A, T39R, T39S, S40P, S40T, E41D, E41V, S42G, S42R, F43L, F43Y, V44H, V44M, V44R, L45I, L45V, N46I, N46V, Y48F, Y48H, Y48N, R49Y, R49L, M50D, M50E, M50I, M50L, M50Q, M50V, M50T, S51G, P52A, P52L, S53D, S53G, S53L, S53N, S53T, S53V, N54C, N54H, N54D, N54G, N54S, N54Y, Q55E, Q55H, Q55K, Q55R, T56A, T56L, T56M, T56P, T56S, T56V, D57F, D57R, D57V, D57Y, K58L, K58R, K58T, L59M, L59R, L59V, A61L, A61S, E64D, E64K, R66H, R66S, S67C, S67G, S67I, S67N, S67R, Q68E, Q68I, Q68L, Q68P, Q68R, Q68T, P69H, P69L, P69S, G70C, G70E, G70F, G70I, G70L, G70N, G70R, G70V, G70S, Q71H, Q71K, Q71L, Q71P, Q71R, D72A, D72G, D72N, C73A, C73G, C73H, C73P, C73S, C73R, C73Y, F75Y, R76G, R76H, R76S, V77D, V77I, T78I, T78S, Q79A, Q79P, Q79R, L80Q, P81S, N82S, R84H, R84Q, D85G, D85N, F86Y, H87L, H87Q, H87R, M88L, M88F, S89G, S89N, V90L, V90M, V91A, V91D, V91I, R92G, R92N, R92S, A93V, R94Q, R95L, R95K, R95G, N96D, N96S, N96T, T100A, T100I, T100S, Y101F, L102F, L102I, L102Y, L102V, G104A, G104T, G104S, G104V, A105C, A105G, A105I, A105L, A105V, I106L, S107A, S107F, S107L, S107T, S107V, L108F, L108I, L108T, L108Y, A109D, A109G, A109H, A109S, P110A, K111E, K111G, K111I, K111M, K111N, K111R, K111T, K111V, A112I, A112P, A112V, Q113R, Q113W, I114T, K115D, K115E, K115IN, K115N, K115Q, K115R, E116D, R119G, R119H, R119L, R119P, R119Q, R119W, A120V, T125A, T125K, T125I, T125S, T125V, R127F, R127L, R127K, R127S, R127V, R128G, R128M, A129S, E130K, V131A, V131E, V131I, V131R, P132H, P132R, P132S, P132T, T133A, T133R, T133S, A134D, A134V, H135N, H135R, H135Y, P136L, P136T, S137C, P138S, P138T, S139T, P140A, P140L, P140R, R141G, R141M, R141S, R141W, P142A, P142L, P142R, P142T, A143D, A143S, A143V, G144D, or G144S, or a conservative amino acid substitution thereof.

In some embodiments, the variant PD-1 is any of the variant PD-1 molecules as described in Section II above, such as any as described in Table 1. Such variant PD-1 polypeptides can be linked, directly or indirectly, to one or more other immunoglobulin superfamily (IgSF) domains as described.

In some embodiments, the variant PD-1 is a variant PD-1 that contains one or more amino acid substitutions from N13D, N13S, F17L, T25A, N29S, A30V, N38D, T39A, V44H, V44R, L45I, L45V, N46I, N46V, Y48F, Y48H, R49Y, R49L, M50D, M50E, M50I, M50L, M50Q, M50V, S53D, S53G, S53L, S53N, S53V, N54C, N54D, N54G, N54S, N54Y, Q55E, Q55H, Q55K, T56A, T56L, T56V, D57F, D57R, D57V, D57Y, K58L, K58T, A61L, A61S, S67G, Q68E, Q68I, Q68L, Q68P, Q68R, Q68T, P69L, P69S, G70F, G70I, G70L, G70N, G70R, G70V, Q71P, Q71R, D72A, D72G, C73S, C73R, R76G, V77I, T78I, Q79A, Q79R, N82S, H87Q, H87R, M88L, M88F, R92G, R95K, R95G, N96D, N96S, Y101F, L102I, L102Y, L102V, G104S, A105I, A105V, S107A, S107F, S107L, S107T, S107V, L108F, L108I, L108Y, A109D, A109H, A109S, P110A, K111E, K111G, K111I, K111R, K111T, K111V, A112I, A112P, A112V, K115R, R119G, A120V, T125A, T125I, T125V, R127F, R127L, R127K, R127V, R128G, V131I, V131R, or a conservative amino acid substitution thereof. In some embodiments, the variant PD-1 polypeptide contains the amino acid substitutions V44H/L45V/N46I/Y48H/M50E/N54G/K58T/L102V/A105V/A112I. In some embodiments, the variant PD-1 polypeptide has the sequence of amino acids set forth in SEQ ID NO:453, or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO:453. Such variant PD-1 polypeptides can be linked, directly or indirectly, to one or more other immunoglobulin superfamily (IgSF) domains as described.

In some embodiments, the sequences of the additional IgSF domains can be a modified IgSF domain that contains one or more amino acid modifications, e.g. substitutions, compared to a wildtype or unmodified IgSF domain. In some embodiments, the IgSF domain can be non-affinity modified (e.g., wild-type) or have been affinity modified. In some embodiments, the unmodified or wild-type IgSF domain can be from mouse, rat, cynomolgus monkey, or human origin, or combinations thereof. In some embodiments, the additional IgSF domains can be an IgSF domain of an IgSF family member set forth in Table 2. In some embodiments, the additional IgSF domain can be an affinity-modified IgSF domain containing one or more amino acid modifications, e.g. substitutions, compared to an IgSF domain contained in an IgSF family member set forth in Table 2.

In some embodiments, the additional IgSF domain is an affinity or non-affinity modified IgSF domain contained in an IgSF family member of a family selected from Signal-Regulatory Protein (SIRP) Family, Triggering Receptor Expressed On Myeloid Cells Like (TREML) Family, Carcinoembryonic Antigen-related Cell Adhesion Molecule (CEACAM) Family, Sialic Acid Binding Ig-Like Lectin (SIGLEC) Family, Butyrophilin Family, B7 family, CD28 family, V-set and Immunoglobulin Domain Containing (VSIG) family, V-set transmembrane Domain (VSTM) family, Major Histocompatibility Complex (MHC) family, Signaling lymphocytic activation molecule (SLAM) family, Leukocyte immunoglobulin-like receptor (LIR), Nectin (Nec) family, Nectin-like (NECL) family, Poliovirus receptor related (PVR) family, Natural cytotoxicity triggering receptor (NCR) family, T cell immunoglobulin and mucin (TIM) family or Killer-cell immunoglobulin-like receptors (KIR) family. In some embodiments, the additional IgSF domains are independently derived from an IgSF protein selected from the group consisting of CD80(B7-1), CD86 (B7-2), CD274 (PD-L1, B7-H1), PDCD1LG2(PD-L2, CD273), ICOSLG(B7RP1, CD275, ICOSL, B7-H2), CD276(B7-H3), VTCN1(B7-H4), CD28, CTLA4, PDCD1 (PD-1), ICOS, BTLA(CD272), CD4, CD8A(CD8-alpha), CD8B(CD8-beta), LAG3, HAVCR2(TIM-3), CEACAM1, TIGIT, PVR(CD155), PVRL2(CD112), CD226, CD2, CD160, CD200, CD200R1(CD200R), NC R3 (NKp30), and VSIG8.

The first column of Table 2 provides the name and, optionally, the name of some possible synonyms for that particular IgSF member. The second column provides the protein identifier of the UniProtKB database, a publicly available database accessible via the internet at uniprot.org or, in some cases, the GenBank Number. The Universal Protein Resource (UniProt) is a comprehensive resource for protein sequence and annotation data. The UniProt databases include the UniProt Knowledgebase (UniProtKB). UniProt is a collaboration between the European Bioinformatics Institute (EMBL-EBI), the SIB Swiss Institute of Bioinformatics and the Protein Information Resource (PIR) and supported mainly by a grant from the U.S. National Institutes of Health (NIH). GenBank is the NIH genetic sequence database, an annotated collection of all publicly available DNA sequences (Nucleic Acids Research, 2013 January; 41(D1):D36-42). The third column provides the region where the indicated IgSF domain is located. The region is specified as a range where the domain is inclusive of the residues defining the range. Column 3 also indicates the IgSF domain class for the specified IgSF region. Column 4 provides the region where the indicated additional domains are located (signal peptide, S; extracellular domain, E; transmembrane domain, T; cytoplasmic domain, C). It is understood that description of domains can vary depending on the methods used to identify or classify the domain, and may be identified differently from different sources. The description of residues corresponding to a domain in Table 2 is for exemplification only and can be several amino acids (such as one, two, three or four) longer or shorter. Column 5 indicates for some of the listed IgSF members, some of its cognate cell surface binding partners.

TABLE 2

IgSF members according to the present disclosure.

| IgSF Member (Synonyms) | NCBI Protein Accession Number/ UniProtKB Protein Identifier | IgSF Region & Domain Class | Other Domains | Cognate Cell Surface Binding Partners | IgSF Member Amino Acid Sequence (SEQ ID NO) | | |
|---|---|---|---|---|---|---|---|
| | | | | | Precursor (mature residues) | Mature | ECD |
| CD80 (B7-1) | NP_005182.1 P33681 | 35-135, 35-138, 37-138, or 35-141 IgV, 145-230 or 154-232 IgC | S: 1-34, E: 35-242, T: 243-263, C: 264-288 | CD28, CTLA4, PD-L1 | SEQ ID NO: 1 (35-288) | SEQ ID NO: 55 | SEQ ID NO: 28 |
| CD86 (B7-2) | P42081.2 | 33-131 IgV, 150-225 IgC2 | S: 1-23, E: 24-247, T: 248-268, C: 269-329 | CD28, CTLA4 | SEQ ID NO: 2 (24-329) | SEQ ID NO: 56 | SEQ ID NO: 29 |
| CD274 (PD-L1, B7-H1) | Q9NZQ7.1 NP_054862.1 | 24-130 or 19-127 IgV, 133-225 IgC2 | S: 1-18, E: 19-238, T: 239-259, C: 260-290 | PD-1, B7-1 | SEQ ID NO: 3 (19-290) | SEQ ID NO: 57 | SEQ ID NO: 30 |
| PDCD1LG2 (PD-L2, CD273) | Q9BQ51.2 | 21-118 IgV, 122-203 IgC2 | S: 1-19, E: 20-220, T: 221-241, C: 242-273 | PD-1, RGMb | SEQ ID NO: 4 (20-273) | SEQ ID NO: 58 | SEQ ID NO: 31 |
| ICOSLG (B7RP1, CD275, ICOSL, B7-H2) | O75144.2 | 19-129 IgV, 141-227 IgC2 | S: 1-18, E: 19-256, T: 257-277, C: 278-302 | ICOS, CD28, CTLA4 | SEQ ID NO: 5 (19-302) | SEQ ID NO: 59 | SEQ ID NO: 32 |
| CD276 (B7-H3) | Q5ZPR3.1 | 29-139 IgV, 145-238 IgC2, 243-357 IgV2, 363-456, 367-453 IgC2 | S: 1-28, E: 29-466, T: 467-487, C: 488-534 | | SEQ ID NO: 6 (29-534) | SEQ ID NO: 60 | SEQ ID NO: 33 |

TABLE 2-continued

IgSF members according to the present disclosure.

| IgSF Member (Synonyms) | NCBI Protein Accession Number/ UniProtKB Protein Identifier | IgSF Region & Domain Class | Other Domains | Cognate Cell Surface Binding Partners | IgSF Member Amino Acid Sequence (SEQ ID NO) | | |
|---|---|---|---|---|---|---|---|
| | | | | | Precursor (mature residues) | Mature | ECD |
| VTCN1 (B7-H4) | Q7Z7D3.1 | 35-146 IgV, 153-241 IgV | S: 1-24, E: 25-259, T: 260-280, C: 281-282 | | SEQ ID NO: 7 (25-282) | SEQ ID NO: 61 | SEQ ID NO: 34 |
| CD28 | P10747.1 | 28-137 IgV | S: 1-18, E: 19-152, T: 153-179, C: 180-220 | B7-1, B7-2, B7RP1 | SEQ ID NO: 8 (19-220) | SEQ ID NO: 62 | SEQ ID NO: 35 |
| CTLA-4 | P16410.3 | 39-140 IgV | S: 1-35, E: 36-161, T: 162-182, C: 183-223 | B7-1, B7-2, B7RP1 | SEQ ID NO: 9 (36-223) | SEQ ID NO: 63 | SEQ ID NO: 36 |
| PDCD1 (PD-1) | Q15116.3 | 35-145 IgV | S: 1-20, E: 21-170, T: 171-191, C: 192-288 | PD-L1, PD-L2 | SEQ ID NO: 10 (21-288) | SEQ ID NO: 64 | SEQ ID NO: 37 |
| ICOS | Q9Y6W8.1 | 30-132 IgV | S: 1-20, E: 21-140, T: 141-161, C: 162-199 | B7RP1 | SEQ ID NO: 11 (21-199) | SEQ ID NO: 65 | SEQ ID NO: 38 |
| BTLA (CD272) | Q7Z6A9.3 | 31-132 IgV | S: 1-30, E: 31-157, T: 158-178, C: 179-289 | HVEM | SEQ ID NO: 12 (31-289) | SEQ ID NO: 66 | SEQ ID NO: 39 |
| CD4 | P01730.1 | 26-125 IgV, 126-203 IgC2, 204-317 IgC2, 317-389, 318-374 IgC2 | S: 1-25, E: 26-396, T: 397-418, C: 419-458 | MHC class II | SEQ ID NO: 13 (26-458) | SEQ ID NO: 67 | SEQ ID NO: 40 |
| CD8A (CD8-alpha) | P01732.1 | 22-135 IgV | S: 1-21, E: 22-182, T: 183-203, C: 204-235 | MHC class I | SEQ ID NO: 14 (22-235) | SEQ ID NO: 68 | SEQ ID NO: 41 |
| CD8B (CD8-beta) | P10966.1 | 22-132 IgV | S: 1-21, E: 22-170, T: 171-191, C: 192-210 | MHC class I | SEQ ID NO: 15 (22-210) | SEQ ID NO: 69 | SEQ ID NO: 42 |
| LAG3 | P18627.5 | 37-167 IgV, 168-252 IgC2, 265-343 IgC2, 349-419 IgC2 | S: 1-28, E: 29-450, T: 451-471, C: 472-525 | MHC class II | SEQ ID NO: 16 (29-525) | SEQ ID NO: 70 | SEQ ID NO: 43 |
| HAVCR2 (TIM-3) | Q8TDQ0.3 | 22-124 IgV | S: 1-21, E: 22-202, T: 203-223, C: 224-301 | CEACAM-1, phosphatidylserine, Galectin-9, HMGB1 | SEQ ID NO: 17 (22-301) | SEQ ID NO: 71 | SEQ ID NO: 44 |
| CEACAM1 | P13688.2 | 35-142 IgV, 145-232 IgC2, 237-317 IgC2, 323-413 IgC2 | S: 1-34, E: 35-428, T: 429-452, C: 453-526 | TIM-3 | SEQ ID NO: 18 (35-526) | SEQ ID NO: 72 | SEQ ID NO: 45 |
| TIGIT | Q495A1.1 | 22-124 IgV | S: 1-21, E: 22-141, T: 142-162, C: 163-244 | CD155, CD112 | SEQ ID NO: 19 (22-244) | SEQ ID NO: 73 | SEQ ID NO: 46 |
| PVR (CD155) | P15151.2 | 24-139 IgV, 145-237 IgC2, 244-328 IgC2 | S: 1-20, E: 21-343, T: 344-367, C: 368-417 | TIGIT, CD226, CD96, poliovirus | SEQ ID NO: 20 (21-417) | SEQ ID NO: 74 | SEQ ID NO: 47 |
| PVRL2 (CD112) | Q92692.1 | 32-156 IgV, 162-256 IgC2, 261-345 IgC2 | S: 1-31, E: 32-360, T: 361-381, C: 382-538 | TIGIT, CD226, CD112R | SEQ ID NO: 21 (32-538) | SEQ ID NO: 75 | SEQ ID NO: 48 |
| CD226 | Q15762.2 | 19-126 IgC2, 135-239 IgC2 | S: 1-18, E: 19-254, T: 255-275, C: 276-336 | CD155, CD112 | SEQ ID NO: 22 (19-336) | SEQ ID NO: 76 | SEQ ID NO: 49 |
| CD2 | P06729.2 | 25-128 IgV, 129-209 IgC2 | S: 1-24, E: 25-209, T: 210-235, C: 236-351 | CD58 | SEQ ID NO: 23 (25-351) | SEQ ID NO: 77 | SEQ ID NO: 50 |

TABLE 2-continued

IgSF members according to the present disclosure.

| IgSF Member (Synonyms) | NCBI Protein Accession Number/ UniProtKB Protein Identifier | IgSF Region & Domain Class | Other Domains | Cognate Cell Surface Binding Partners | IgSF Member Amino Acid Sequence (SEQ ID NO) | | |
|---|---|---|---|---|---|---|---|
| | | | | | Precursor (mature residues) | Mature | ECD |
| CD160 | O95971.1 | 27-122 IgV | N/A | HVEM, MHC family of proteins | SEQ ID NO: 24 (27-159) | SEQ ID NO: 78 | SEQ ID NO: 51 |
| CD200 | P41217.4 | 31-141 IgV, 142-232 IgC2 | S: 1-30, E: 31-232, T: 233-259, C: 260-278 | CD200R | SEQ ID NO: 25 (31-278) | SEQ ID NO: 79 | SEQ ID NO: 52 |
| CD200R1 (CD200R) | Q8TD46.2 | 53-139 IgV, 140-228 IgC2 | S: 1-28, E: 29-243, T: 244-264, C: 265-325 | CD200 | SEQ ID NO: 26 (29-325) | SEQ ID NO: 80 | SEQ ID NO: 53 |
| NCR3 (NKp30) | O14931.1 | 19-126 IgC-like | S: 1-18, E: 19-135, T: 136-156, C: 157-201 | B7-H6 | SEQ ID NO: 27 (19-201) | SEQ ID NO: 81 | SEQ ID NO: 54 |
| VSIG8 | Q5VU13 | 22-141 IgV1, 146-257 IgV2 | S: 1-21 E: 22-263 T: 264-284 C: 285-414 | VISTA | SEQ ID NO: 82 (22-414) | SEQ ID NO: 83 | SEQ ID NO: 84 |

In some embodiments, the provided immunomodulatory proteins, in addition to containing a variant PD-1 polypeptide, also contains at least 1, 2, 3, 4, 5 or 6 additional immunoglobulin superfamily (IgSF) domains, such as an IgD domain of an IgSF family member set forth in Table 2. In some embodiments, the provided immunomodulatory protein contains at least one additional IgSF domain (e.g. second IgSF domain). In some embodiments, the provided immunomodulatory protein contains at least two additional IgSF domains (e.g. second and third IgSF domain). In some embodiments, the provided immunomodulatory protein contains at least three additional IgSF domains (e.g. second, third and fourth). In some embodiments, the provided immunomodulatory protein contains at least four additional IgSF domains (e.g. second, third, fourth and fifth). In some embodiments, the provided immunomodulatory protein contains at least five additional IgSF domains (e.g. second, third, fourth, fifth and sixth). In some embodiments, the provided immunomodulatory protein contains at least six additional IgSF domains (e.g. second, third, fourth, fifth, sixth and seventh). In some embodiments, each of the IgSF domains in the immunomodulatory protein are different. In some embodiments, at least one of the additional IgSF domain is the same as at least one other IgSF domain in the immunomodulatory protein. In some embodiments, each of the IgSF domains is from or derived from a different IgSF family member. In some embodiments, at least two of the IgSF domains is from or derived from the same IgSF family member.

In some embodiments, the additional IgSF domain comprises an IgV domain or an IgC (e.g., IgC2) domain or domains, or a specific binding fragment of the IgV domain or a specific binding fragment of the IgC (e.g., IgC2) domain or domains. In some embodiments, the additional IgSF domain is or comprises a full-length IgV domain. In some embodiments, the additional IgSF domain is or comprises a full-length IgC (e.g., IgC2) domain or domains. In some embodiments, the additional IgSF domain is or comprises a specific binding fragment of the IgV domain. In some embodiments, the additional IgSF domain is or comprises a specific binding fragment of the IgC (e.g., IgC2) domain or domains. In some embodiments, the immunomodulatory protein contains at least two additional IgSF domains from a single (same) IgSF member. In some cases, the additional IgSF domain is or comprises the extracellular domain or a portion thereof containing an IgV domain or a specific binding fragment thereof.

In some embodiments, the provided immunomodulatory proteins contains at least one additional IgSF domain (e.g. a second or, in some cases, also a third IgSF domain and so on) in which at least one additional, e.g. a second or third IgSF domain, is an IgSF domain set forth in a wild-type or unmodified IgSF domain or a specific binding fragment thereof contained in the sequence of amino acids set forth in any of SEQ ID NOS: 1-27 and 82. In some embodiments, the wild-type or unmodified IgSF domain is an IgV domain or an IgC domain, such as an IgC1 or IgC2 domain.

In some embodiments, the provided immunomodulatory proteins, in addition to containing a variant PD-1 polypeptide, also contains at least one additional affinity-modified IgSF domain (e.g. a second or, in some cases, also a third affinity-modified IgSF domain and so on) in which at least one additional IgSF domain is a vIgD that contains one or more amino acid modifications (e.g. substitution, deletion or mutation) compared to an IgSF domain in a wild-type or unmodified IgSF domain, such as an IgSF domain in an IgSF family member set forth in Table 2. In some embodiments, the additional, e.g., second or third, affinity-modified IgSF domain comprises at least 85%, 86%, 87%, 88%, 89%, 90%, 91%, 92%, 93%, 94%, 95%, 96%, 97%, 98%, 99% or more sequence identity to a wild-type or unmodified IgSF domain or a specific binding fragment thereof contained in the sequence of amino acids set forth in any of SEQ ID NOS: 1-27 and 82. In some embodiments, the wild-type or unmodified IgSF domain is an IgV domain or an IgC domain, such as an IgC1 or IgC2 domain. In some embodiments, the additional, e.g., or second or third, IgSF domain is an affinity-modified IgV domain and/or IgC domain. In some embodiments, the one or more additional IgSF domain is an affinity-modified IgSF domain that contains an IgV domain and/or an IgC (e.g., IgC2) domain or domains, or a specific binding fragment of the IgV domain and/or a specific binding fragment of the IgC (e.g., IgC2) domain or domains, in which the IgV and/or IgC domain contains the amino acid modification(s) (e.g., substitution(s)). In some embodiments, the one or more additional affinity-modified IgSF domain contains an IgV domain containing the amino acid modification(s) (e.g. substitution(s)). In some embodiments, the one or more additional affinity-modified IgSF domain include IgSF domains present in the ECD or a portion of the ECD of the corresponding unmodified IgSF family member, such as a full-length IgV domain and a full-length IgC (e.g., IgC2) domain or domains, or specific binding fragments thereof, in which one or both of the IgV and IgC contain the amino acid modification(s) (e.g. substitution(s)). In some cases, the one or more additional IgSF domain is or comprises the extracellular domain or a portion thereof containing the IgV domain or a specific binding fragment thereof.

In some embodiments, the provided immunomodulatory protein contains at least one additional (e.g. or second or, in some cases, also a third IgSF domain and so on) IgSF domain that is a vIgD that contains one or more amino acid substitutions compared to an IgSF domain (e.g. IgV) of a wild-type or unmodified IgSF domain other than PD-1.

The number of such non-affinity modified or affinity modified IgSF domains present in a "stacked" immunomodulatory protein construct (whether non-wild type combinations or non-wild type arrangements) is at least 2, 3, 4, or 5 and in some embodiments exactly 2, 3, 4, or 5 IgSF domains (whereby determination of the number of affinity modified IgSF domains disregards any non-specific binding fractional sequences thereof and/or substantially immunologically inactive fractional sequences thereof).

In some embodiments of a stacked immunomodulatory protein provided herein, the number of IgSF domains is at least 2 wherein the number of affinity modified and the number of non-affinity modified IgSF domains is each independently at least: 0, 1, 2, 3, 4, 5, or 6. Thus, the number of affinity modified IgSF domains and the number of non-affinity modified IgSF domains, respectively, (affinity modified IgSF domain: non-affinity modified IgSF domain), can be exactly or at least: 2:0 (affinity modified: wild-type), 0:2, 2:1, 1:2, 2:2, 2:3, 3:2, 2:4, 4:2, 1:1, 1:3, 3:1, 1:4, 4:1, 1:5, or 5:1.

In some embodiments of a stacked immunomodulatory protein, at least two of the non-affinity modified and/or affinity modified IgSF domains are identical IgSF domains.

In some embodiments of a stacked immunomodulatory protein, the non-affinity modified and/or affinity modified IgSF domains are non-identical (i.e., different) IgSF domains. Non-identical affinity modified IgSF domains specifically bind, under specific binding conditions, different cognate binding partners and are "non-identical" irrespective of whether or not the wild-type or unmodified IgSF domains from which they are engineered was the same. Thus, for example, a non-wild-type combination of at least two non-identical IgSF domains in an immunomodulatory protein can comprise at least one IgSF domain sequence whose origin is from and unique to one PD-1, and at least one of a second IgSF domain sequence whose origin is from and unique to another IgSF family member that is not PD-1, wherein the IgSF domains of the immunomodulatory protein are in non-affinity modified and/or affinity modified form. However, in alternative embodiments, the two non-identical IgSF domains originate from the same IgSF domain sequence but at least one is affinity modified such that they specifically bind to different cognate binding partners.

A plurality of non-affinity modified and/or affinity modified IgSF domains in a stacked immunomodulatory protein polypeptide chain need not be covalently linked directly to one another. In some embodiments, an intervening span of one or more amino acid residues indirectly covalently bonds the non-affinity modified and/or affinity modified IgSF domains to each other. The linkage can be via the N-terminal to C-terminal residues.

In some embodiments, the two or more IgSF domain, including a vIgD of PD-1 and one or more additional IgSF domain (e.g. second or third variant IgSF domain) from another IgSF family member, are covalently or non-covalently linked. In some embodiments, the two or more IgSF domains are linked directly or indirectly, such as via a linker. In some embodiments, an intervening span of one or more amino acid residues indirectly covalently bonds IgSF domains to each other. The linkage can be via the N-terminal to C-terminal residues. In some embodiments, the linkage can be made via side chains of amino acid residues that are not located at the N-terminus or C-terminus of the IgSF domain(s). Thus, linkages can be made via terminal or internal amino acid residues or combinations thereof.

Figure 4:
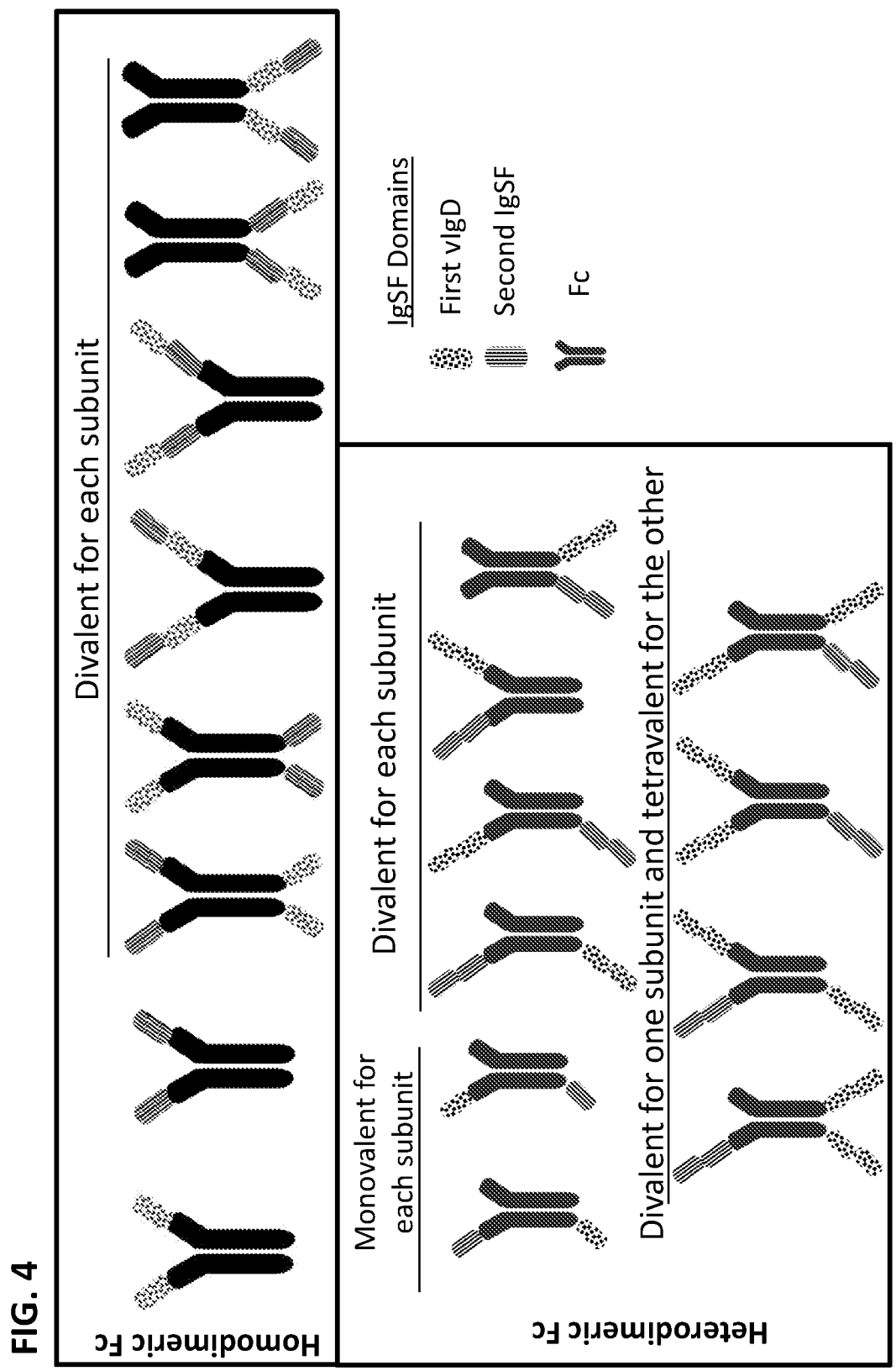
FIG. 4 depicts various exemplary configurations of a stack molecule containing a first variant IgSF domain (first vIgD) and a second IgSF domain, such as a second variant IgSF domain (second vIgD). As shown, the first vIgD and second IgSF domain are independently linked, directly or indirectly, to the N- or C-terminus of an Fc region. For generating a homodimeric Fc molecule, the Fc region is one that is capable of forming a homodimer with a matched Fc region by co-expression of the individual Fc region in a cell. For generating a heterodimeric Fc molecule, the individual Fc region contain mutations (e.g. "knob-into-hole" mutations in the CH3 domain), such that formation of the heterodimer is favored compared to homodimers when the individual Fc region are co-expressed in a cell. In an exemplary embodiment, the first variant IgSF domain (first vIgD) of the stack molecule is a PD-1, such as a variant PD-1 polypeptide and the second IgSF domain is a CD28 binding molecule (e.g., a ICOSL such as a variant ICOSL polypeptide).

In some embodiments, the immunomodulatory protein contains at least two IgSF domains, each linked directly or indirectly via a linker. In some embodiments, the immunomodulatory protein contains at least three immunomodulatory proteins, each linked directly or indirectly via a linker. Various configurations are shown in FIG. 4.

In some embodiments, one or more "peptide linkers" link the vIgD of PD-1 and one or more additional IgSF domain (e.g., second or third variant IgSF domain). In some embodiments, a peptide linker can be a single amino acid residue or greater in length. In some embodiments, the peptide linker has at least one amino acid residue but is no more than 20, 19, 18, 17, 16, 15, 14, 13, 12, 11, 10, 9, 8, 7, 6, 5, 4, 3, 2, or 1 amino acid residues in length. In some embodiments, the linker is a flexible linker. In some embodiments, the linker is (in one-letter amino acid code): GGGGS ("4GS"; SEQ ID NO: 472) or multimers of the 4GS linker, such as repeats of 2, 3, 4, or 5 4GS linkers. In some embodiments, the peptide linker is (GGGGS)$_2$ (SEQ ID NO: 474) or (GGGGS)$_3$ (SEQ ID NO: 473). In some embodiments, the linker (in one-letter amino acid code) is GSGGGGS (SEQ ID NO: 471). In some embodiments, the linker also can include a series of alanine residues alone or in addition to another peptide linker (such as a 4GS linker or multimer thereof). In some embodiments, the number of alanine residues in each series is: 2, 3, 4, 5, or 6 alanines. In some embodiments, the linker also can include a series of alanine residues alone or in addition to another peptide linker (such as a 4GS linker or multimer thereof). In some embodiments, the number of alanine residues in each series is: 2, 3, 4, 5, or 6 alanines. In some embodiments, the linker is a rigid linker. For example, the linker is an α-helical linker. In some embodiments, the linker is (in one-letter amino acid code): EAAAK or multimers of the EAAAK linker, such as repeats of 2, 3, 4, or 5 EAAAK linkers, such as set forth in SEQ ID NO: 634 (1×EAAAK), SEQ ID NO: 635 (3×EAAAK) or SEQ ID NO: 636 (5×EAAAK). In some embodiments, the linker can further include amino acids introduced by cloning and/or from a restriction site, for example the linker can include the amino acids GS (in one-letter amino acid code) as introduced by use of the restriction site BAMHI. For example, in some embodiments, the linker (in one-letter amino acid code) is GSGGGGS (SEQ ID NO:471), GS(G$_4$S)$_3$ (SEQ ID NO: 643), or GS(G$_4$S)$_5$ (SEQ ID NO: 644). In some examples, the linker is a 2×GGGGS followed by three alanines (GGGGSGGGGSAAA; SEQ ID NO: 475). In some cases, the immunomodulatory polypeptide comprising a variant PD-1 comprises various combinations of peptide linkers.

In some embodiments, the two or more IgSF domain, including a vIgD of PD-1 and one or more additional IgSF domain (e.g. second and/or third variant IgSF domain) from another IgSF family member, are linked or attached to an Fc to form an Fc fusion, which, upon expression in a cell can, in some aspects, produce a dimeric multi-domain stack immunomodulatory protein. Thus, also provided are dimeric multi-domain immunomodulatory proteins.

In some embodiments, the variant PD-1 polypeptide and one or more additional IgSF domain are independently linked, directly or indirectly, to the N- or C-terminus of an Fc region. In some embodiments, the variant PD-1 polypeptide and at least one of the one or more additional IgSF domain are linked, directly or indirectly, and one of the variant PD-1 and one of the one or more additional IgSF domain is also linked, directly or indirectly, to the N- or C-terminus of an Fc region. In some embodiments, the N- or C-terminus of the Fc region is linked to the variant PD-1 polypeptide or the one or more additional IgSF domain and the other of the N- or C-terminus of the Fc region is linked to the other of the PD-1 variant or another of the one or more additional IgSF domain. In some embodiments, linkage to the Fc is via a peptide linker, e.g. a peptide linker, such as described above. In some embodiments, linkage between the variant PD-1 and the one or more additional IgSF domain is via a peptide linker, e.g. a peptide linker, such as described above. In some embodiments, the vIgD of PD-1, the one or more additional IgSF domains, and the Fc domain can be linked together in any of numerous configurations as depicted in FIG. 4. Exemplary configurations are described in the Examples.

In some embodiments, the stacked immunomodulatory protein is a dimer formed by two immunomodulatory Fc fusion polypeptides. Also provided are nucleic acid molecules encoding any of the stacked immunomodulatory proteins. In some embodiments, the dimeric multi-domain stack immunomodulatory protein can be produced in cells by expression, or in some cases co-expression, of stack immunomodulatory Fc fusion polypeptides, such as described above in accord with generating dimeric Fc fusion proteins.

In some embodiments, the dimeric multi-domain stack immunomodulatory protein is divalent for each Fc region, monovalent for each subunit, or divalent for one subunit and tetravalent for the other.

In some embodiments, the Fc portion of the first and/or second fusion polypeptide can be any Fc as described, such as set forth in Section III.A. In some embodiments, the Fc domain is an IgG1, IgG2 or IgG4, or is a variant thereof with reduced effector function. In some embodiments, the Fc domain is an IgG1, e.g. human IgG1, or is a variant thereof containing one or more amino acid substitutions that reduces effector function. In some cases, the one or more amino acid substitutions are any as described above in Section III.A. In some embodiments, the one or more amino acid substitutions are one or more of E233P, L234A, L234V, L235A, L235E, G236del, G237A, S267K, or N297G, each numbered according to EU index by Kabat. In some embodiments, the Fc domain contains amino acid substitutions R292C/N297G/V302C. In some embodiments, the Fc domain contains amino acid substitutions L234A/L235E/G237A. In some aspects, the Fc domain can further contain an amino acid substitution C220S. In some aspects, the Fc domain can further contain the amino acid modification K447del.

In some embodiments, the dimeric multi-domain stack immunomodulatory protein is a homodimeric multi-domain stack Fc protein. In some embodiments, the dimeric multi-domain stack immunomodulatory protein comprises a first stack immunomodulatory Fc fusion polypeptide and a second stack immunomodulatory Fc fusion polypeptide in which the first and second polypeptide are the same. In some embodiments, the multi-domain stack molecule contains a first Fc fusion polypeptide containing a variant PD-1 and a second IgSF domain and a second Fc fusion polypeptide containing the variant PD-1 and the second IgSF domain. In some embodiments, the multi-domain stack molecule contains a first Fc fusion polypeptide containing a variant PD-1, a second IgSF domain, and a third IgSF domain and a second Fc fusion polypeptide containing the variant PD-1, the second IgSF domain, and the third IgSF domain. In some embodiments, the Fc domain of the first and second fusion polypeptide is the same. In some embodiments, the Fc domain of the first and second polypeptide is or comprises the sequence of amino acids set forth in SEQ ID NO:384 or 476, or a sequence of amino acids that exhibits at least 85%, 86%, 87%, 88%, 89%, 90%, 91%, 92%, 93%, 94%, 95%, 96%, 97%, 98% or 99% sequence identity to SEQ ID NO:384 or 476.

In some embodiments, the multi-domain stack molecule is heterodimeric, comprising two different Fc fusion polypeptides, e.g. a first and a second Fc fusion polypeptide, wherein at least one is an Fc fusion polypeptide containing at least one is an Fc fusion polypeptide containing a variant PD-1 polypeptide and/or at least one second IgSF domain (e.g. second variant IgSF domain). In some embodiments, the first or second Fc fusion polypeptide further contains a third IgSF domain (e.g. third variant IgSF domain).

In some embodiments, the multi-domain stack molecule contains a first Fc fusion polypeptide containing a variant PD-1and a second Fc fusion polypeptide containing a second IgSF domain, in which, in some cases, the first or second Fc fusion polypeptide additionally contains a third IgSF domain. In some embodiments, the multi-domain stack molecule contains a first Fc fusion polypeptide containing a variant PD-1, a second IgSF domain, and in some cases, a third IgSF domain and a second Fc fusion polypeptide that is not linked to either a variant PD-1 polypeptide or an additional IgSF domain. In some embodiments, the Fc portion or region of the first and second fusion polypeptide is the same. In some embodiments, the Fc portion or region of the first and second fusion polypeptide is different.

In some embodiments, the multi-domain stack molecule contains a first Fc fusion polypeptide containing 1, 2, 3, 4 or more variant PD-1 polypeptides and 1, 2, 3, 4 or more additional IgSF domains, wherein the total number of IgSF domains in the first stack Fc fusion polypeptide is greater than 2, 3, 4, 5, 6 or more. In one example of such an embodiment, the second stack Fc fusion polypeptide contains 1, 2, 3, 4 or more variant PD-1 polypeptides and 1, 2, 3, 4 or more additional IgSF domains, wherein the total number of IgSF domains in the second stack Fc fusion polypeptide is greater than 2, 3, 4, 5, 6 or more. In another example of such an embodiment, the second Fc fusion polypeptide is not linked to either a variant PD-1 polypeptide or additional IgSF domain.

In some embodiments, the heterodimeric stack molecule contains a first stack immunomodulatory Fc fusion polypeptide and a second stack immunomodulatory Fc fusion polypeptide in which the first and second polypeptide are different. In some embodiments, a heterodimeric stack molecule contains a first Fc polypeptide fusion containing an Fc region and a first variant PD-1 polypeptide and/or second IgSF domain (e.g. second variant IgSF domain) and a second polypeptide fusion containing an Fc region and the other of the first variant PD-1 polypeptide or the second IgSF domain. In some embodiments, a heterodimeric stack molecule contains a first Fc polypeptide fusion containing an Fc region and a first variant PD-1 polypeptide and/or second IgSF domain (e.g. second variant IgSF domain) and a second Fc polypeptide fusion containing an Fc region and the first variant PD-1 polypeptide and second IgSF domain (e.g. second variant IgSF domain) but in a different orientation or configuration from the first Fc region. In some embodiments, the first and/or second Fc fusion polypeptide also contains a third IgSF domain (e.g. third variant IgSF domain).

In some embodiments, the Fc domain of one or both of the first and second stacked immunomodulatory Fc fusion polypeptide comprises a modification (e.g. substitution) such that the interface of the Fc molecule is modified to facilitate and/or promote heterodimerization. In some embodiments, modifications include introduction of a protuberance (knob) into a first Fc polypeptide and a cavity (hole) into a second Fc polypeptide such that the protuberance is positionable in the cavity to promote complexing of the first and second Fc-containing polypeptides. Amino acids targeted for replacement and/or modification to create protuberances or cavities in a polypeptide are typically interface amino acids that interact or contact with one or more amino acids in the interface of a second polypeptide.

In some embodiments, a first polypeptide that is modified to contain protuberance (hole) amino acids include replacement of a native or original amino acid with an amino acid that has at least one side chain which projects from the interface of the first polypeptide and is therefore positionable in a compensatory cavity (hole) in an adjacent interface of a second polypeptide. Most often, the replacement amino acid is one which has a larger side chain volume than the original amino acid residue. One of skill in the art knows how to determine and/or assess the properties of amino acid residues to identify those that are ideal replacement amino acids to create a protuberance. In some embodiments, the replacement residues for the formation of a protuberance are naturally occurring amino acid residues and include, for example, arginine (R), phenylalanine (F), tyrosine (Y), or tryptophan (W). In some examples, the original residue identified for replacement is an amino acid residue that has a small side chain such as, for example, alanine, asparagine, aspartic acid, glycine, serine, threonine, or valine.

In some embodiments, a second polypeptide that is modified to contain a cavity (hole) is one that includes replacement of a native or original amino acid with an amino acid that has at least one side chain that is recessed from the interface of the second polypeptide and thus is able to accommodate a corresponding protuberance from the interface of a first polypeptide. Most often, the replacement amino acid is one which has a smaller side chain volume than the original amino acid residue. One of skill in the art knows how to determine and/or assess the properties of amino acid residues to identify those that are ideal replacement residues for the formation of a cavity. Generally, the replacement residues for the formation of a cavity are naturally occurring amino acids and include, for example, alanine (A), serine (S), threonine (T) and valine (V). In some examples, the original amino acid identified for replacement is an amino acid that has a large side chain such as, for example, tyrosine, arginine, phenylalanine, or tryptophan.

The CH3 interface of human IgG1, for example, involves sixteen residues on each domain located on four anti-parallel β-strands which buries 1090 A2 from each surface (see e.g., Deisenhofer et al. (1981) Biochemistry, 20:2361-2370; Miller et al., (1990) J Mol. Biol., 216, 965-973; Ridgway et al., (1996) Prot. Engin., 9: 617-621; U.S. Pat. No. 5,731,168). Modifications of a CH3 domain to create protuberances or cavities are described, for example, in U.S. Pat. No. 5,731,168; International Patent Applications WO98/50431 and WO 2005/063816; and Ridgway et al., (1996) Prot. Engin., 9: 617-621. In some examples, modifications of a CH3 domain to create protuberances or cavities are typically targeted to residues located on the two central anti-parallel β-strands. The aim is to minimize the risk that the protuberances which are created can be accommodated by protruding into the surrounding solvent rather than being accommodated by a compensatory cavity in the partner CH3 domain.

In some embodiments, the heterodimeric molecule contains a T366W mutation in the CH3 domain of the "knobs chain" and T366S, L368A, Y407V mutations in the CH3 domain of the "hole chain". In some cases, an additional interchain disulfide bridge between the CH3 domains can also be used (Merchant, A. M., et al., Nature Biotech. 16 (1998) 677-681) e.g. by introducing a Y349C mutation into the CH3 domain of the "knobs" or "hole" chain and a E356C mutation or a S354C mutation into the CH3 domain of the other chain. In some embodiments, the heterodimeric molecule contains S354C, T366W mutations in one of the two CH3 domains and Y349C, T366S, L368A, Y407V mutations in the other of the two CH3 domains. In some embodiments, the heterodimeric molecule comprises E356C, T366W mutations in one of the two CH3 domains and Y349C, T366S, L368A, Y407V mutations in the other of the two CH3 domains. In some embodiments, the heterodimeric molecule comprises Y349C, T366W mutations in one of the two CH3 domains and E356C, T366S, L368A, Y407V mutations in the other of the two CH3 domains. In some embodiments, the heterodimeric molecule comprises Y349C, T366W mutations in one of the two CH3 domains and S354C, T366S, L368A, Y407V mutations in the other of the two CH3 domains. Examples of other knobs-in-holes technologies are known in the art, e.g. as described by EP 1 870 459 A1. An exemplary knob Fc molecule and hole Fc molecule are set forth in SEQ ID NOS: 382 and 383, respectively.

In some embodiments, the Fc region of the heterodimeric molecule additionally can contain one or more other Fc mutation, such as any described above. In some embodiments, the heterodimer molecule contains an Fc region with a mutation that reduces effector function.

In some embodiments, an Fc variant containing CH3 protuberance (knob) or cavity (hole) modifications can be joined to a stacked immunomodulatory polypeptide anywhere, but typically via its N- or C-terminus, to the N- or C-terminus of a first and/or second stacked immunomodulatory polypeptide, such as to form a fusion polypeptide. The linkage can be direct or indirect via a linker. Typically, a knob and hole molecule is generated by co-expression of a first stacked immunomodulatory polypeptide linked to an Fc variant containing CH3 protuberance modification(s) with a second stacked immunomodulatory polypeptide linked to an Fc variant containing CH3 cavity modification(s).

In some embodiments, a sequence of amino acids is added preceding the Fc sequence for constructs in which the Fc sequence is the N-terminal portion of the sequence. In some cases, the sequence of amino acids HMSSVSAQ (SEQ ID NO:385) is added immediately preceding the Fc sequence for constructs in which the Fc sequence is the N-terminal portion of the sequence. In some embodiments, a heterodimeric stack molecule contains a first Fc polypeptide fusion containing an Fc region (knob) and a first variant polypeptide and/or second IgSF domain (e.g. second variant IgSF domain) and a second Fc polypeptide fusion containing an Fc region (hole) contains a stuffer sequence HMSSVSAQ (SEQ ID NO:385) immediately preceding both Fc regions of the first and second Fc polypeptide fusion.

C. CD28-Binding Molecules

In some embodiments, the one or more additional IgSF domain (e.g. second or third IgSF) domain is an IgSF domain (e.g. ECD or IgV) of another IgSF family member that is a CD28-binding molecule capable of specifically binding to CD28. In some aspects, the one or more additional IgSF domain (e.g. second or third IgSF) domain is an affinity-modified IgSF domain that is a variant IgSF domain (vIgD) of an IgSF family member that bind to CD28 and that contains one or more amino acid substitutions in an IgSF domain (e.g. IgV), in which, in some cases, the one or more amino acid modifications result in increased binding to CD28. In some embodiments, the vIgD contains one or more amino acid modifications (e.g. substitutions, deletions or additions) in a wild-type or unmodified IgSF domain (e.g. IgV) of an IgSF family member that binds to CD28. In some embodiments, the one or more additional IgSF domain is from an IgSF family member selected from ICOSL, CD86, or CD80. In some embodiments, the one or more vIgD of PD-1 of the immunomodulatory "stack" molecules binds PD-L1 expressed on a tumor cell, thereby localizing the immunomodulatory protein containing the one or more further CD28-binding IgSF domain for interaction with T cells via binding to CD28. Thus, in some aspects, the immunomodulatory proteins provided herein facilitate modulation of immune cells in the vicinity of the tumor.

In some embodiments, there is provided an immunomodulatory protein containing any one of the variant PD-1 polypeptides and one or more IgSF domain of a CD28-binding IgSF family member, such as a wild-type or unmodified IgSF domain of a CD28-binding IgSF family member. In some embodiments, there is provided an immunomodulatory protein containing any one of the variant PD-1 polypeptides and one or more IgSF domain of CD80, e.g. wild-type or unmodified CD80, such as an ECD or a portion thereof (containing the IgV and IgC domain or specific binding fragments thereof, e.g. set forth in SEQ ID NO:28 or a portion thereof. In some embodiments, there is provided an immunomodulatory protein containing any one of the variant PD-1 polypeptides and one or more IgSF domain of ICOSL, e.g. wild-type or unmodified ICOSL, such as an ECD or a portion thereof (containing the IgV and IgC domain or specific binding fragments thereof, e.g. set forth in SEQ ID NO:32 or a portion thereof. In some embodiments, there is provided an immunomodulatory protein containing any one of the variant PD-1 polypeptides and one or more IgSF domain of CD86, e.g. wild-type or unmodified CD86, such as an ECD or a portion thereof (containing the IgV and IgC domain or specific binding fragments thereof), e.g. set forth in SEQ ID NO:29 or a portion thereof.

In some embodiments, there is provided an immunomodulatory protein containing a variant PD-1 as provided herein and one or more additional IgSF domain (e.g., second or third IgSF) that is an affinity-modified vIgD of an IgSF family member that binds to CD28. In some embodiments, the further affinity-modified IgSF domain is a variant IgSF domain that contains one or more amino acid modifications (e.g. amino acid substitutions, deletions or insertions) in an IgSF domain (e.g. IgV) that results in increased binding affinity for CD28 compared to the unmodified IgSF domain, such as binding affinity that is increased more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. In some embodiments, the one or more amino acid modifications in an IgV domain.

1. ICOS Ligand

In some embodiments, the at least one additional (e.g. second) vIgD is a variant ICOSL that contains one or more amino acid modifications (e.g. substitutions, deletions or additions) in an IgSF domain (e.g. IgV) of ICOSL, which is an IgSF family member that bind to the activating receptor CD28. In some embodiments, a variant ICOSL polypeptide has a binding affinity for CD28 that differs from that of a wild-type or unmodified ICOSL polypeptide control sequence as determined by, for example, solid-phase ELISA immunoassays, flow cytometry or Biacore assays. Binding affinities for each of the cognate binding partners are independent; that is, in some embodiments, a variant ICOSL polypeptide has an increased binding affinity for one, two or three of CD28, ICOS, and/or CTLA-4, and a decreased binding affinity for one, two or three of CD28, ICOS, and CTLA-4, relative to a wild-type or unmodified ICOSL polypeptide. In some embodiments, the variant ICOSL polypeptide has an increased binding affinity for CD28. The CD28 can be a mammalian protein, such as a human protein or a murine protein.

In some embodiments, the IgSF domain of ICOSL comprises an IgV domain or an IgC (e.g. IgC2) domain or specific binding fragment of the IgV domain or the IgC (e.g. IgC2) domain, or combinations thereof. In some embodiments, the IgD can be an IgV only, the combination of the IgV and IgC, including the entire extracellular domain (ECD), or any combination of Ig domains of ICOSL. In some embodiments, the wild-type or unmodified ICOSL polypeptide has (i) the sequence of amino acids set forth in SEQ ID NO: 5 or a mature form thereof lacking the signal sequence, (ii) a sequence of amino acids that exhibits at least about 85%, 86%, 87%, 88%, 89%, 90%, 91%, 92%, 93%, 94%, 95%, 96%, 97%, 98%, 99% sequence identity to SEQ ID NO: 5 or a mature form thereof, or (iii) is a portion of (i) or (ii) containing an IgV domain or IgC domain or specific binding fragments thereof. In some embodiments, there is provided an immunomodulatory protein containing any of the provided variant PD-1 polypeptides and a variant ICOSL polypeptide containing an IgV and/or IgC domains and that contains the one or more amino acid modifications. In some embodiments, there is provided an immunomodulatory protein containing any of the provided variant PD-1 polypeptides and a variant ICOSL polypeptide containing an IgV domain that contains the one or more amino acid modifications.

In some embodiments, the variant ICOSL polypeptide has an increased binding affinity for CD28, relative to a wild-type or unmodified ICOSL polypeptide. In some embodiments, a variant ICOSL polypeptide with increased or greater binding affinity to CD28 will have an increase in binding affinity relative to the wild-type or unmodified ICOSL polypeptide control of at least about 5%, such as at least about 10%, 15%, 20%, 25%, 35%, or 50% for the CD28. In some embodiments, the increase in binding affinity relative to the wild-type or unmodified ICOSL polypeptide is more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. In such examples, the wild-type or unmodified ICOSL polypeptide has the same sequence as the variant ICOSL polypeptide except that it does not contain the one or more amino acid modifications (e.g. substitutions).

In some embodiments, the equilibrium dissociation constant ($K_d$) of any of the foregoing embodiments to CD28 can be less than $1\times10^{-5}$M, $1\times10^{-6}$ M, $1\times10^{-7}$ M, $1\times10^{-8}$M, $1\times10^{-9}$ M, $1\times10^{-10}$ M or $1\times10^{-11}$M, or $1\times10^{-12}$ M.

In some embodiments, the amino acid modification is any as set forth in International PCT published application No. WO2017/181148. Unless stated otherwise, as indicated throughout the present disclosure, the amino acid substitution(s) are designated by amino acid position number corresponding to the numbering of positions of the unmodified ECD sequence set forth in SEQ ID NO:32 as follows:

DTQEKEVRAMVGSDVELSCACPEGSRFDLNDV-
YVYWQTSESKTVVTYHIPQNSSLENVDSRY
RNRALMSPAGMLRGDFSLRLFNVTPQDEQ-
KFHCLVLSQSLGFQEVLSVEVTLHVAANFSVPV
VSAPHSPSQDELTFTCTSINGYPRPNVYWINK-
TDNSLLDQALQNDTVFLNMRGLYDVVSVLRI
ARTPSVNIGCCIENVLLQQNLTVGSQTGNDIGER-
DKITENPVSTGEKNAAT (SEQ ID NO:32)

It is within the level of a skilled artisan to identify the corresponding position of a modification, e.g. amino acid substitution, in an ICOSL polypeptide, including portion thereof containing an IgSF domain (e.g. IgV) thereof, such as by alignment of a reference sequence with SEQ ID NO:32. In the listing of modifications throughout this disclosure, the amino acid position is indicated in the middle, with the corresponding unmodified (e.g. wild-type) amino acid listed before the number and the identified variant amino acid substitution listed after the number. If the modification is a deletion of the position a "del" is indicated and if the modification is an insertion at the position an "ins" is indicated.

Modifications provided herein can be in a wild-type or unmodified ICOSL polypeptide set forth in SEQ ID NO: 32 or in a portion thereof contain an IgV domain or a specific binding fragment thereof. In some embodiments, the wild-type or unmodified ICOSL polypeptide contains the IgV of ICOSL as set forth in SEQ ID NO: 805 or 806. In some embodiments, the unmodified ICOSL polypeptide contains an IgV that can be several amino acids longer or shorter, such as 1-10, e.g. 1, 2, 3, 4, 5, 6 or 7 amino acids longer or shorter, than the sequence of amino acids set forth in SEQ ID NOs: 805 or 806. In some embodiments, the unmodified ICOSL polypeptide has 85%, 85%, 87%, 88%, 89%, 90%, 91%, 92%, 93%, 94%, 95%, 96%, 97%, 98%, 99% sequence identity to SEQ ID NO: 32, 805, or 806. In some embodiments, the unmodified ICOSL polypeptide has the sequence set forth in any of SEQ ID NOs: 32, 805, or 806.

(SEQ ID NO: 806)
DTQEKEVRAMVGSDVELSCACPEGSRFDLNDVYVYWQTSESKTVVTYHIP

QNSSLENVDSRYRNRALMSPAGMLRGDFSLRLFNVTPQDEQKFHCLVLSQ

SLGFQEVLSVE (SEQ ID NO: 805)
DTQEKEVRAMVGSDVELSCACPEGSRFDLNDVYVYWQTSESKTVVTYHIP

QNSSLENVDSRYRNRALMSPAGMLRGDFSLRLFNVTPQDEQKFHCLVLSQ

SLGFQEVLSVEVTLHVAANFSV

In some embodiments, the variant ICOSL polypeptide has one or more amino acid modification, e.g. substitution in a wild-type or unmodified ICOSL sequence. The one or more amino acid modification, e.g. substitution can be in the ectodomain (extracellular domain) of the wild-type or unmodified ICOSL sequence. In some embodiments, the one or more amino acid modification, e.g. substitution is in the IgV domain or specific binding fragment thereof. In some embodiments, the one or more amino acid modification, e.g. substitution is in the IgC domain or specific binding fragment thereof. In some embodiments of the variant ICOSL polypeptide, some of the one or more amino acid modification, e.g. substitution is in the IgV domain or a specific binding fragment thereof, and some of the one or more amino acid modification, e.g. substitution are in the IgC domain or a specific binding fragment thereof.

In some embodiments, the variant ICOSL polypeptide has up to 1, 2, 3, 4, 5, 6, 7, 8, 9, 10, 11, 12, 13, 14, 15, 16, 17, 18, 19, or 20 amino acid modification(s), e.g. substitution. The modification, e.g. substitution can be in the IgV domain or the IgC domain. In some embodiments, the variant ICOSL polypeptide has up to 1, 2, 3, 4, 5, 6, 7, 8, 9, 10, 11, 12, 13, 14, 15, 16, 17, 18, 19, or 20 amino acid substitutions in the IgV domain or specific binding fragment thereof. In some embodiments, the variant ICOSL polypeptide has up to 1, 2, 3, 4, 5, 6, 7, 8, 9, 10, 11, 12, 13, 14, 15, 16, 17, 18, 19, or 20 amino acid substitutions in the IgC domain or specific binding fragment thereof. In some embodiments, the variant ICOSL polypeptide has at least about 85%, 86%, 86%, 88%, 89%, 90%, 91%, 92%, 93%, 94%, 95%, 96%, 97%, 98%, or 99% sequence identity with the wild-type or unmodified ICOSL polypeptide or specific binding fragment thereof, such as with the amino acid sequence of SEQ ID NO: 32.

In some embodiments, the variant ICOSL polypeptide has one or more amino acid modification, e.g. substitution in an unmodified ICOSL or specific binding fragment there of corresponding to position(s) 10, 11, 13, 16, 18, 20, 25, 27, 30, 33, 37, 42, 43, 47, 52, 54, 57, 61, 62, 67, 71, 72, 74, 77, 78, 75, 80, 84, 89, 90, 92, 93, 94, 96, 97, 98, 99, 100, 102, 103, 107, 109, 110, 111, 113, 115, 116, 117, 119, 120, 121, 122, 126, 129, 130, 132, 133, 135, 138, 139, 140, 142, 143, 144, 146, 151, 152, 153, 154, 155, 156, 158, 161, 166, 168, 172, 173, 175, 190, 192, 193, 194, 198, 201, 203, 207, 208, 210, 212, 217, 218, 220, 221, 224, 225, or 227 with reference to numbering of SEQ ID NO:32. In some embodiments, such variant ICOSL polypeptides exhibit altered binding affinity to one or more of CD28, ICOS, and/or CTLA-4 compared to the wild-type or unmodified ICOSL polypeptide. In some embodiments, such variant ICOSL polypeptides exhibit altered binding affinity to one or more of human CD28, human ICOS, and/or human CTLA-4 compared to the wild-type or unmodified ICOSL polypeptide.

In some embodiments, the variant ICOSL polypeptide has one or more amino acid modification, e.g. substitution selected from M10V, M10I, V11E, S13G, E16V, S18R, A20V, S25G, F27S, F27C, N30D, Y33del, Q37R, K42E, T43A, Y47H, N52H, N52D, N52Q, N52S, N52Y, N52K, S54A, S54P, N57D, N57Y, R61S, R61C, Y62F, L67P, A71T, G72R, L74Q, R75Q, D77G, F78L, L80P, N84Q, D89G, E90A, K92R, F93L, H94E, H94D, L96F, L96I, V97A, L98F, S99G, Q100R, Q100K, Q100P, L102R, G103E, V107A, V107I, S109G, S109N, V110D, V110N, V110A, E111del, T113E, H115R, H115Q, V116A, A117T, N119Q, F120I, F120S, S121G, V122A, V122M, S126T, S126R, H129P, S130G, S132F, Q133H, E135K, F138L, T139S, C140D, C140del, S142F, I143V, I143T, N144D, Y146C, V151A, Y152C, Y152H, W153R, I154F, N155H, N155Q, K156M, D158G, L161P, L161M, L166Q, N168Q, F172S, L173S, M175T, T190S, T190A, S192G, V193M, N194D, C198R, N201S, L203P, L203F, N207Q, L208P, V210A, S212G, D217V, I218T, I218N, E220G, R221G, R221I, I224V, T225A, or N227K, or a conservative amino acid modification, e.g. substitution thereof. A conservative amino acid modification, e.g. substitution is any amino acid that falls in the same class of amino acids as the substituted amino acids, other than the wild-type or unmodified amino acid. The classes of amino acids are aliphatic (glycine, alanine, valine, leucine, and isoleucine), hydroxyl or sulfur-containing (serine, cysteine, threonine, and methionine), cyclic (proline), aromatic (phenylalanine, tyrosine, tryptophan), basic (histidine, lysine, and arginine), and acidic/amide (aspartate, glutamate, asparagine, and glutamine).

In some embodiments, the variant ICOSL polypeptide has one or more amino acid modification, e.g. substitution selected from M10V, M10I, V11E, S13G, E16V, S18R, A20V, S25G, F27S, F27C, N30D, Y33del, Q37R, K42E, T43A, Y47H, N52H, N52D, N52Q, N52S, N52Y, N52K, S54A, S54P, N57D, N57Y, R61S, R61C, Y62F, L67P, A71T, G72R, L74Q, R75Q, D77G, F78L, L80P, N84Q, D89G, E90A, K92R, F93L, H94E, H94D, L96F, L96I, V97A, L98F, S99G, Q100R, Q100K, Q100P, G103E, L102R, V107A, V107I, S109G, S109N, V110D, V110N, V110A, E111del, T113E, H115R, H115Q, V116A, A117T, N119Q, F120I, F120S, S121G, V122A, V122M, S126T, S126R, H129P, S130G, S132F, Q133H, E135K, F138L, T139S, C140D, C140del, S142F, I143V, I143T, N144D, Y146C, V151A, Y152C, Y152H, W153R, I154F, N155H, N155Q, K156M, D158G, L161P, L161M, L166Q, N168Q, F172S, L173S, M175T, T190A, T190S, S192G, V193M, N194D, C198R, N201S, L203P, L203F, N207Q, L208P, V210A, S212G, D217V, I218T, I218N, E220G, R221G, R221I, I224V, T225A, N227K.

In some embodiments, the one or more amino acid modification, e.g. substitution is N52Y/N57Y/F138L/L203P, N52H/N57Y/Q100P, N52S/Y146C/Y152C, N52H/C198R, N52H/C140D/T225A, N52H/C198R/T225A, N52H/K92R, N52H/S99G, N57Y/Q100P, N52S/G103E, N52S/S130G/Y152C, N52S/Y152C, N52S/C198R, N52Y/N57Y/Y152C, N52Y/N57Y/H129P/C198R, N52H/L161P/C198R, N52S/T113E, N52D/S54P, N52K/L208P, N52S/Y152H, N52D/V151A, N52H/I143T, N52S/L80P, F120S/Y152H/N201S, N52S/R75Q/L203P, N52S/D158G, N52D/Q133H, N52S/N57Y/H94D/L96F/L98F/Q100R, N52S/N57Y/H94D/L96F/L98F/Q100R/G103E/F120S, N52H/F78L/Q100R, N52H/N57Y/Q100R/V110D, N52H/N57Y/R75Q/Q100R/V110D, N52H/N57Y/Q100R, N52H/N57Y/L74Q/Q100R/V110D, N52H/Q100R, N52H/S121G, A20V/N52H/N57Y/Q100R/S109G, N52H/N57Y/Q100P, N52H/N57Y/R61S/Q100R/V110D/L173S, N52H/N57Y/Q100R/V122A, N52H/N57Y/Q100R/F172S, N52H/N57Y, N52S/F120S, N52S/V97A, N52S/G72R, N52S/A71T/A117T, N52S/E220G, Y47H/N52S/V107A/F120S, N52H/N57Y/Q100R/V110D/S132F/M175T, E16V/N52H/N57Y/Q100R/V110D/H115R/Y152C/K156M/C198R, Q37R/N52H/N57Y/Q100R/V110N/S142F/C198R/D217V/R221G, N52H/N57Y/Q100R/V110D/C198R, N52H/N57Y/Q100R/V110D/V116A/L161M/F172S/S192G/C198R, F27S/N52H/N57Y/V110N, N52S/H94E/L96I/S109N/L166Q, S18R/N52S/F93L/I143V/R221G, A20T/N52D/Y146C/Q164L, V11E/N30D/N52H/N57Y/H94E/L96I/L98F/N194D/V210A/I218T, N52S/H94E/L96I/V122M, N52H/N57Y/H94E/L96I/F120I/S126T/W153R/I218N, M10V/S18R/N30D/N52S/S126R/T139S/L203F, S25G/N30D/N52S/F120S/N227K, N30D/N52S/L67P/Q100K/D217G/R221K/T225 S, N52H/N57Y/Q100R/V110D/A117T/T190S/C198R, N52H/N57Y/Q100R/V110D/F172S/C198R, S25G/F27C/N52H/N57Y/Q100R/V110D/E135K/L173S/C198R, N52H/N57Y/V110A/C198R/R221I, M10I/S13G/N52H/N57Y/D77G/V110A/H129P/I143V/F172S/V193M, C198R, N52H/N57Y/R61C/Y62F/Q100R/V110N/F120S/C198R, N52H/N57Y/Q100R/V110D/H115R/C198R, N52H/N57Y/Q100R/V110D/N144D/F172S/C198R, N52S/H94E/L98F/Q100R, N52S/E90A, N30D/K42E/N52S, N52S/F120S/I143V/I224V, N52H/N57Y/Q100R/V110D/C198R/S212G, N52H/N57Y/Q100R/C198R, N52S/N194D, N52H/N57Y/Q100R/L102R/V110D/H115R/C198R, N52S/S54P, T38P/N52S/N57D, N52H/C140del/T225A, N52H/F78L/Q100R/C198R, N52H/N57Y/R75Q/Q100P/V110D, N52H/N57Y/L74Q/V110D/S192G, N52H/S121G/C198R, N52S/F120S/N227K, N52S/A71T/A117T/T190A/C198R, T43A/N52H/N57Y/L74Q/D89G/V110D/F172S, N52H/N57Y/Q100R/V110D/S132F/M175T, N52H/N57Y/Q100R/V107I/V110D/I154F/C198R/R221G, Q100R, F138L/L203P, N57Y/F138L/L203P, N57Y/Q100R/C198R, N57Y/F138L/L203P, Q100R/F138L, L203P, N52H/N57Y/Q100R/H115R/C198R, N52H/N57Y/Q100R/F172S/C198R, N52H/N57Y/Q100R/H115R/F172S/C198R, N52H/N57Y/Q100R/H115R/I143V/F172S/C198R, N52H/N57Y/Q100R/L102R/H115R/F172S/C198R, N52H/V122A/F172S/C198R, N52H/N57Y/Q100R/H115R/F172S/N194D, N52H/N57Y/H115R/F172S/C198R, N52H/N57Y/Q100R/H115R/C198R, N52H/N57Y/H115R, N52H/N57Y/Q100R/H115R, N52H/N57Y/Q100R/H115R/F172S/I224V, N52H/N57Y/Q100R/H115R/F172S, N52H/N57Y/Q100R/F172S, N52H/Q100R/H115R/I143T/F172S, N52H/N57Y/Q100P/H115R/F172S, N52Y/N57Y/Q100P/F172S, E16V/N52H/N57Y/Q100R/V110D/H115R/C198R, E16V/N52H/N57Y/Q100R/V110D/H115R/Y152C/K156M/F172S/C198R, N52S/E90A/H115R, N30D/K42E N52S/H115R, N30D/K42E/N52S/H115R/C198R/R221I, N30D/K42E/N52S/H115R/C198R, N30D/K42E/N52S/H115R/F172S/N194D, N52S/H115R/F120S/I143V/C198R, N52S/H115R/F172S/C198R, N52H/N57Y/Q100P/C198R, N52H/N57Y/Q100P/H115R/F172S/C198R, N52H/N57Y/Q100P/F172S/C198R, N52H/N57Y/Q100P/H115R, N52H/N57Y/Q100P/H115R/C198R, N52H/Q100R/C198R, N52H/Q100R/H115R/F172S, N52H/Q100R/F172S/C198R, N52H/Q100R/H115Q/F172S/C198R, N52H/N57Y/Q100R/F172S/C198R, N52Q/N207Q, N168Q/N207Q, N52Q/N168Q, N84Q/N207Q, N155Q/N207Q, N119Q/N168Q, N119Q/N207Q, N119Q/N155Q, N52Q/N84Q, N52Q/N119Q, N84Q/N119Q, N52Q/N84Q/N168Q, N52Q/N84Q/N207Q, N84Q/N155Q/N168Q, N84Q/N168Q/N207Q, N84Q/N155H/N207Q, N155Q/N168Q/N207Q, N119Q/N155Q/N168Q, N119Q/N168Q/N207Q, N84Q/N119Q/N207Q, N119Q/N155H/N207Q, N84Q/N119Q/N155Q, N52Q/N119Q/N155Q, N52H/N84Q/N119Q, N52H/N84Q, N52H/N84Q/N168Q, N52H/N84Q/N207Q, N52H/N84Q/N168Q/N207Q, N52Q/N84Q/N155Q, N52Q/N84Q/N168Q, N52Q/N84Q/N155Q/N168Q, N52Q/N84Q/N119Q/N168Q, N84Q/N119Q/N155Q/N168Q, N84Q/N155Q/N168Q/N207Q, N84Q/N119Q/N155Q/N207Q, N52Q/N84Q/N119Q/N207Q, N52Q/N84Q/N119Q/N155Q, N52Q/N84Q/N119Q/N155Q/N207Q or, N84Q/N119Q/N155Q/N168Q/N207Q.

In some embodiments, the variant ICOSL polypeptide exhibits increased binding affinity to CD28 (e.g. human CD28) compared to a wild-type or unmodified ICOSL polypeptide. In some embodiments, the variant ICOSL polypeptide has one or more amino acid modifications (e.g., substitutions) in an unmodified ICOSL or specific binding fragment there of corresponding to position(s) 10, 11, 13, 16, 18, 20, 25, 27, 30, 37, 42, 52, 54, 57, 71, 72, 74, 77, 80, 84, 90, 92, 93, 94, 96, 98, 99, 100, 102, 107, 109, 110, 113, 1115, 117, 119, 120, 121, 122, 126, 129, 130, 132, 133, 135, 138, 139, 140, 142, 143, 144, 146, 152, 153, 154, 155, 156, 158, 161, 164, 166, 168, 172, 173, 190, 192, 193, 194, 198, 203, 207, 208, 210, 212, 217, 218, 221, 224, 225, or 227.

In some embodiments, the variant ICOSL polypeptide has one or more amino acid substitution selected from M10I, M10V, V11E, S13G, E16V, S18R, A20T, A20V, S25G, F27C, F27S, N30D, Q37R, K42E, N52H, N52D, N52K, N52Q, N52S, N52Y, S54A, S54P, N57Y, A71T, G72R, L74Q, D77G, L80P, N84Q, E90A, K92R, F93L, H94E, L96I, L98F, S99G, Q100P, Q100R, L102R, V107I, S109G, S109N, V110A, V110D, V110N, T113E, H115R, H115Q, A117T, N119Q, F120I, F120S, S121G, V122A, V122M, S126R, S126T, H129P, S130G, S132F, Q133H, E135K, F138L, T139S, C140del, S142F, I143T, I143V, N144D, Y146C, Y152C, Y152H, W153R, I154F, N155Q, K156M, D158G, L161P, Q164L, L166Q, N168Q, F172S, L173S, T190A, S192G, V193M, N194D, C198R, L203F, L203P, N207Q, L208P, V210A, S212G, D217V, I218N, I218T, R221G, R221I, I224V, T225A, or N227K, or a conservative amino acid substitution thereof.

In some embodiments, the one or more amino acid modification, e.g. substitution is N52S, N52H, N52D, N52Y/N57Y/F138L/L203P, N52H/N57Y/Q100P N52S/Y146C/Y152C, N52H/C198R, N52H/C140del/T225A, N52H/C198R/T225A, N52H/K92R, N52H/S99G, N57Y N57Y/Q100P, N52S/S130G/Y152C, N52S/Y152C, N52S/C198R, N52Y/N57Y/Y152C, N52Y/N57Y/H129P/C198R, N52H/L161P/C198R, N52S/T113E, S54A, N52D/S54P, N52K/L208P, N52S/Y152H, N52H/I143T, N52S/L80P, N52S/D158G, N52D/Q133H, N52H/N57Y/Q100R/V110D/C198R/S212G, N52H/N57Y/L74Q/V110D/S192G, N52H/Q100R, N52H/S121G/C198R, A20V/N52H/N57Y/Q100R/S109G, N52H/N57Y/Q100P/C198R, N52H/N57Y/Q100R/V122A, N52H/N57Y/Q100R/F172S, N52H/N57Y/Q100R, N52S/F120S/N227K, N52S/N194D, N52S/F120S, N52S/G72R, N52S/A71T/A117T/T190A/C198R, N52H/N57Y/Q100R/V107I/V110D/S132F/I154F/C198R/R221G, E16V/N52H/N57Y/Q100R/V110D/H115R/Y152C/K156M/C198R, Q37R/N52H/N57Y/Q100R/V110N/S142F/C198R/D217V/R221G, N52H/N57Y/Q100R/V110D/C198R, F27S/N52H/N57Y/V110N, N52S/H94E/L96I/S109N/L166Q, S18R/N52S/F93L/I143V/R221G, A20T/N52D/Y146C/Q164L, V11E/N30D/N52H/N57Y/H94E/L96I/L98F/N194D/V210A/I218T, N52S/H94E/L96I/V122M, N52H/N57Y/H94E/L96I/F120I/S126T/W153R/I218N, M10V/S18R/N30D/N52S/S126R/T139S/L203F, S25G/N30D/N52S/F120S/N227K, N52H/N57Y/Q100R/V110D/F172S/C198R, S25 G/F27C/N52H/N57Y/Q100R/V110D/E135K/L173 S/C198R, N52H/N57Y/V110A/C198R/R221I, M10I/S13G/N52H/N57Y/D77G/V110A/H129P/I143V/F172S/V193M/C198R, N52H/N57Y/Q100R/L102R/V110D/H115R/C198R, N52H/N57Y/Q100R/V110D/N144D/F172S/C198R, N52S/H94E/L98F/Q100R, N52S/E90A, N52S/F120S/I143V/I224V, N52H/I143T, N52H/N57Y/Q100R/C198R, N52H/N57Y/Q100R/V122A, N52H/N57Y/Q100R/F172S, N52Y/N57Y/F138L/L203P, V11E/N30D/N52H/N57Y/H94E/L96I/L98F/N194D/V210A/I218T, N52H/N57Y/Q100R/L102R/V110D/H115R/C198R, N52H/N57Y/Q100R/V110D/C198R/S212G, E16V/N52H/N57Y/Q100R/V110D/H115R/Y152C/K156M/C198R, N52H/N57Y/V110A/C198R/R221I, N52D, N52H/N57Y/Q100R/F172S/C198R, N52H/N57Y/Q100R/H115R/F172S/C198R, N52Y/N57Y/Q100P/F172S, E16V/N52H/N57Y/Q100R/V110D/H115R/Y152C/K156M/F172S/C198R, N52S/H115R/F120S/I143V/C198R, N52H/N57Y/Q100P/H115R/F172S/C198R, N52H/N57Y/Q100P/F172S/C198R, N52H/N57Y/Q100P/H115R, N52H/N57Y/Q100P/H115R/C198R, N52H/Q100R/H115R/F172S, N52H/Q100R/H115X/F172S/C198R, N52H/Q100R/H115R/F172S/C198R, N52H/N57Y/Q100R/H115R/F172S/C198R, N52H/N57Y/Q100R/H115R/F172S, Q100R, N52Y/F138L/L203P, N57Y/Q100R/C198R, N57Y/F138L/L203P, N57Y, N57Y/Q100P, Q100R/F138L, L203P, N52H/N57Y/Q100R/H115R, N52H/N57Y/Q100R/F172S, N52H/N57Y/Q100R/H115R/F172S/I224V, N52H/N57Y/Q100R/H115R/F172S, N52H/N57Y/Q100R/H115R/C198R, N52H/N57Y/Q100R/F172S/C198R, N52H/N57Y/Q100R/H115R/F172S/C198R, N52H/N57Y/Q100R/H115R/I143V/F172S/C198R, N52H/N57Y/Q100R/L102R/H115R/F172S/C198R, N52H/N57Y/Q100R/H115R/F172S/N194D, N52H/N57Y/H115R/F172S/C198R, N52H/N57Y/Q100R/H115R/C198R, N52H/N57Y/H115R, N52H/Q100R/H115R/I143T/F172S, N52H/N57Y/Q100P/H115R/F172S, E16V/N52H/N57Y/Q100R/V110D/H115R/C198R, N30D/K42E/N52S/H115R/C198R/R221I, N52S/E90A/H115R, N30D/K42E/N52S/H115R, N52S/H115R/F172S/C198R, N119Q, N207Q, N52Q/N207X, N168X/N207X, N52Q/N168Q, N84Q/N207Q, N119Q/N168Q, N119Q/N207Q, N119Q/N155X, N52Q/N119Q, N52Q/N84Q/N207Q, N119Q/N155Q/N168Q, N52H/N84Q/N119Q, N52Q/N84Q/N155X/N168X, or N52Q/N84Q/N119Q/N168Q.

In some embodiments, there is provided an immunomodulatory protein containing any of the variant PD-1 polypeptides and an ICOSL polypeptide that has the sequence of amino acids set forth in any of SEQ ID NOs: 805-810, or a sequence of amino acids that exhibits at least about 85%, 86%, 87%, 88%, 89%, 90%, 91%, 92%, 93%, 94%, 95%, 96%, 97%, 98%, 99% sequence identity to SEQ ID NOs: 805-810.

There is provided herein a stack molecule that is a stack immunomodulatory that is a multimer containing a first and second polypeptide each containing a variant PD-1 polypeptide and a second IgSF domain, e.g. IgV, of a variant ICOSL polypeptide, wherein the first and second polypeptides are each linked to a multimerization domain, such as an Fc domain. In some aspects, the provided stack immunomodulatory protein is an Fc fusion. In some embodiments, the first and second polypeptides are the same and the stack molecule is a homodimeric Fc fusion protein. In some embodiments, the first and second polypeptide has the sequence set forth in any of SEQ ID NOS: 477-487 or a sequence of amino acids that has at least 85%, 86%, 87%, 88%, 89%, 90%, 91%, 92%, 93%, 94%, 95%, 96%, 97%, 98%, 99% or more sequence identity to any of SEQ ID NOS: 477-487. In some embodiments, the resulting stack molecules bind to both PD-L1 and CD28. In some aspects, the binding to PD-L1 is to the same or similar degree or, in some cases, is increased, compared to the binding to PD-L1 of the corresponding IgSF domain of unmodified or wild-type PD-1. In some aspects, the binding to CD28 is to the same or similar degree, or, in some cases, is increased, compared to the binding to CD28 of the corresponding IgSF domain of unmodified or wild-type ICOSL. In some embodiments, the binding to PD-L1 or CD28 is at least 30%, 40%, 50%, 60%, 70%, 80%, 90%, or more of the binding to PD-L1 or CD28 of the non-stacked form of the variant PD-1 IgSF-Fc. In some embodiments, the binding to CD28 is at least 30%, 40%, 50%, 60%, 70%, 80%, 90% or more of the binding to CD28 of the non-stacked form of the variant ICOSL IgSF-Fc. In some embodiments, such immunomodulatory proteins exhibit increased T cell immune responses compared to the non-stack variant PD-1 IgSF-Fc and/or variant ICOSL-IgSF-Fc, such as determined in a reporter assay. In some embodiments, the increase is greater than 1.2-fold, 1.3-fold, 1.4-fold, 1.5-fold, 2.0-fold, 3.0-fold, 4.0-fold, 5.0-fold or more.

2. CD80

In some embodiments, the at least one additional (e.g., second or third) vIgD is an IgSF domain (e.g. IgV) of a variant CD80 polypeptide that contains one or more amino acid modifications (e.g., substitutions, deletions or additions) in the IgSF domain (e.g., IgV) compared to unmodified or wild-type CD80, which, in some aspects, result in increased binding to the activating receptor CD28. In some embodiments, there is provided an immunomodulatory protein containing any of the provided variant PD-1 polypeptides and a variant CD80 polypeptide containing an ECD or IgV domain containing one more amino acid modifications. In some embodiments, there is provided an immunomodulatory protein containing any of the provided variant PD-1 polypeptides and a variant CD80 polypeptide containing an ECD or a portion thereof containing the IgV and/or IgC domains, that contains one or more amino acid modifications.

In some embodiments, there is provided an immunomodulatory protein containing any one of the variant PD-1 polypeptides and one or more IgSF domain of CD80. In some embodiments, the IgSF domain of CD80 comprises an IgV domain or an IgC (e.g. IgC2) domain or specific binding fragment of the IgV domain or the IgC (e.g. IgC2) domain, or combinations thereof. In some embodiments, the IgD can be an IgV only, the combination of the IgV and IgC, including the entire extracellular domain (ECD), or any combination of Ig domains of CD80. In some embodiments, the variant CD80 polypeptide contains an IgV domain, or an IgC domain, or specific binding fragments thereof in which the at least one amino acid modification (e.g., substitution) in the IgV domain or IgC domain or the specific binding fragment thereof. In some embodiments, the variant CD80 polypeptide contains an IgV domain or specific binding fragments thereof in which the at least one of the amino acid modifications (e.g., substitutions) is in the IgV domain or a specific binding fragment thereof. In some embodiments, by virtue of the altered binding activity or affinity, the altered IgV domain or IgC domain is an affinity modified IgSF domain.

In some embodiments, the variant is modified in one more IgSF domains relative to the sequence of an unmodified CD80 sequence. In some embodiments, the unmodified CD80 sequence is a wild-type CD80. In some embodiments, the unmodified or wild-type CD80 has the sequence of a native CD80 or an ortholog thereof. In some embodiments, the unmodified CD80 is or comprises the extracellular domain (ECD) of CD80 or a portion thereof containing one or more IgSF domain. In some embodiments, the extracellular domain of an unmodified or wild-type CD80 polypeptide comprises an IgV domain and an IgC domain or domains. However, the variant CD80 polypeptide need not comprise both the IgV domain and the IgC domain or domains. In some embodiments, the variant CD80 polypeptide comprises or consists essentially of the IgV domain or a specific binding fragment thereof. In some embodiments, the variant CD80 polypeptide comprises or consists essentially of the IgC domain or specific binding fragments thereof. In some embodiments, the variant CD80 is soluble and lacks a transmembrane domain. In some embodiments, the variant CD80 further comprises a transmembrane domain and, in some cases, also a cytoplasmic domain.

In some embodiments, the wild-type or unmodified CD80 polypeptide is a mammalian CD80 polypeptide, such as, but not limited to, a human, a mouse, a cynomolgus monkey, or a rat CD80 polypeptide. In some embodiments, the wild-type or unmodified CD80 sequence is human.

In some embodiments, the wild-type or unmodified CD80 polypeptide has (i) the sequence of amino acids set forth in SEQ ID NO: 1 or a mature form thereof lacking the signal sequence, (ii) a sequence of amino acids that exhibits at least about 85%, 86%, 87%, 88%, 89%, 90%, 91%, 92%, 93%, 94%, 95%, 96%, 97%, 98%, 99% sequence identity to SEQ ID NO: 1 or a mature form thereof, or (iii) is a portion of (i) or (ii) containing an IgV domain or IgC domain or specific binding fragments thereof.

In some embodiments, the wild-type or unmodified CD80 polypeptide is or comprises an extracellular domain of the CD80 or a portion thereof. For example, in some embodiments, the unmodified or wild-type CD80 polypeptide comprises the amino acid sequence set forth in SEQ ID NO: 28, or an ortholog thereof. For example, the unmodified or wild-type CD80 polypeptide can comprise (i) the sequence of amino acids set forth in SEQ ID NO:28, (ii) a sequence of amino acids that has at least about 85%, 86%, 87%, 88%, 89%, 90%, 91%, 92%, 93%, 94%, 95%, 96%, 97%, 98%, 99% sequence identity to SEQ ID NO: 28, or (iii) is a specific binding fragment of (i) or (ii) comprising an IgV domain or an IgC domain. In some embodiments, the wild-type or unmodified extracellular domain of CD80 is capable of binding one or more CD80 cognate binding proteins, such as one or more of CD28, PD-L1 or CTLA-4.

In some embodiments, the wild-type or unmodified CD80 polypeptide contains an IgV domain or an IgC domain, or a specific binding fragment thereof. In some embodiments, the IgC domain of the wild-type or unmodified CD80 polypeptide comprises the amino acid sequence set forth as residues 145-230 or 154-232 of SEQ ID NO: 1, or an ortholog thereof. For example, the IgC domain of the unmodified or wild-type CD80 polypeptide can contain (i) the sequence of amino acids set forth residues 145-230 or 154-232 of SEQ ID NO: 1, (ii) a sequence of amino acids that has at least about 85%, 86%, 87%, 88%, 89%, 90%, 91%, 92%, 93%, 94%, 95%, 96%, 97%, 98%, 99% sequence identity to residues 145-230 or 154-232 of SEQ ID NO: 1, or (iii) is a specific binding fragment of (i) or (ii). In some embodiments, the wild-type or unmodified IgC domain is capable of binding one or more CD80 cognate binding proteins.

In some embodiments, the wild-type or unmodified CD80 polypeptide contains a specific binding fragment of CD80, such as a specific binding fragment of the IgV domain or the IgC domain. In some embodiments the specific binding fragment can bind CD28, PD-L1, and/or CTLA-4. The specific binding fragment can have an amino acid length of at least 50 amino acids, such as at least 60, 70, 80, 90, 100, or 110 amino acids. In some embodiments, the specific binding fragment of the IgV domain contains an amino acid sequence that is at least about 85%, 86%, 87%, 88%, 89%, 90%, 91%, 92%, 93%, 94%, 95%, 96%, 97%, 98%, 99% of the length of the IgV domain set forth as amino acids 35-135 or 37-138 of SEQ ID NO: 1. In some embodiments, the specific binding fragment of the IgC domain comprises an amino acid sequence that is at least about 85%, 86%, 87%, 88%, 89%, 90%, 91%, 92%, 93%, 94%, 95%, 96%, 97%, 98%, 99% of the length of the IgC domain set forth as amino acids 145-230 or 154-232 of SEQ ID NO: 1.

In some embodiments, the variant CD80 polypeptide comprises the ECD domain or a portion thereof comprising one or more affinity modified IgSF domains. In some embodiments, the variant CD80 polypeptides can comprise an IgV domain or an IgC domain, or a specific binding fragment of the IgV domain or a specific binding fragment of the IgC domain in which at least one of the IgV or IgC domain contains the one or more amino acid modifications (e.g., substitutions). In some embodiments, the variant CD80 polypeptides can comprise an IgV domain and an IgC domain, or a specific binding fragment of the IgV domain and a specific binding fragment of the IgC domain. In some embodiments, the variant CD80 polypeptide comprises a full-length IgV domain. In some embodiments, the variant CD80 polypeptide comprises a full-length IgC domain. In some embodiments, the variant CD80 polypeptide comprises a specific binding fragment of the IgV domain. In some embodiments, the variant CD80 polypeptide comprises a specific binding fragment of the IgC domain. In some embodiments, the variant CD80 polypeptide comprises a full-length IgV domain and a full-length IgC domain. In some embodiments, the variant CD80 polypeptide comprises a full-length IgV domain and a specific binding fragment of an IgC domain. In some embodiments, the variant CD80 polypeptide comprises a specific binding fragment of an IgV domain and a full-length IgC domain. In some embodiments, the variant CD80 polypeptide comprises a specific binding fragment of an IgV domain and a specific binding fragment of an IgC domain.

In any of such embodiments, the one or more amino acid modifications (e.g., substitutions) of the variant CD80 polypeptides can be located in any one or more of the CD80 polypeptide domains. For example, in some embodiments, one or more amino acid modifications (e.g., substitutions) are located in the extracellular domain of the variant CD80 polypeptide. In some embodiments, one or more amino acid modifications (e.g., substitutions) are located in the IgV domain or specific binding fragment of the IgV domain. In some embodiments, one or more amino acid modifications (e.g., substitutions) are located in the IgC domain or specific binding fragment of the IgC domain.

It is understood that reference to amino acids, including to a specific sequence set forth as a SEQ ID NO used to describe domain organization of an IgSF domain are for illustrative purposes and are not meant to limit the scope of the embodiments provided. It is understood that polypeptides and the description of domains thereof are theoretically derived based on homology analysis and alignments with similar molecules. Thus, the exact locus can vary, and is not necessarily the same for each protein. Hence, the specific IgSF domain, such as specific IgV domain or IgC domain, can be several amino acids (such as one, two, three or four) longer or shorter.

In some embodiments, the variant CD80 polypeptides containing at least one affinity-modified IgSF domain (e.g. IgV or IgC) or a specific binding fragment thereof relative to an IgSF domain contained in a wild-type or unmodified CD80 polypeptide such that the variant CD80 polypeptide exhibits altered binding activity or affinity for one or more ligands CD28, PD-L1 or CTLA-4 compared to a wild-type or unmodified CD80 polypeptide. In some embodiments, a variant CD80 polypeptide has a binding affinity for CD28, PD-L1, and/or CTLA-4 that differs from that of a wild-type or unmodified CD80 polypeptide control sequence as determined by, for example, solid-phase ELISA immunoassays, flow cytometry or Biacore assays. Binding affinities for each of the cognate binding partners are independent; that is, in some embodiments, a variant CD80 polypeptide has an increased binding affinity for one, two or three of CD28, PD-L1, and CTLA-4, and/or a decreased binding affinity for one, two or three of CD28, PD-L1, and CTLA-4, relative to a wild-type or unmodified CD80 polypeptide.

In some embodiments, the variant CD80 polypeptide has an increased binding affinity for CD28. The CD28 can be a mammalian protein, such as a human protein or a murine protein. In some embodiments, the variant CD80 polypeptide has an increased binding affinity for CD28, relative to a wild-type or unmodified CD80 polypeptide. In some embodiments, a variant CD80 polypeptide with increased or greater binding affinity to CD28 will have an increase in binding affinity relative to the wild-type or unmodified CD80 polypeptide control of at least about 5%, such as at least about 10%, 15%, 20%, 25%, 35%, or 50% for the CD28. In some embodiments, the increase in binding affinity relative to the wild-type or unmodified CD80 polypeptide is more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. In such examples, the wild-type or unmodified CD80 polypeptide has the same sequence as the variant CD80 polypeptide except that it does not contain the one or more amino acid modifications (e.g., substitutions).

In some embodiments, the equilibrium dissociation constant ($K_d$) of any of the foregoing embodiments to CD28, PD-L1, and/or CTLA-4 can be less than $1\times10^{-5}$ M, $1\times10^{-6}$ M, $1\times10^{-7}$ M, $1\times10^{-8}$ M, $1\times10^{-9}$ M, $1\times10^{-10}$ M or $1\times10^{-11}$ M, or $1\times10^{-12}$ M.

The wild-type or unmodified CD80 sequence does not necessarily have to be used as a starting composition to generate variant CD80 polypeptides described herein. Therefore, use of the term "substitution" does not imply that the provided embodiments are limited to a particular method of making variant CD80 polypeptides. Variants CD80 polypeptides can be made, for example, by de novo peptide synthesis and thus does not necessarily require a "substitution" in the sense of altering a codon to encode for the substitution. This principle also extends to the terms "addition" and "deletion" of an amino acid residue which likewise do not imply a particular method of making. The means by which the variant CD80 polypeptides are designed or created is not limited to any particular method. In some embodiments, however, a wild-type or unmodified CD80 encoding nucleic acid is mutagenized from wild-type or unmodified CD80 genetic material and screened for desired specific binding affinity and/or induction of IFN-gamma expression or other functional activity according to the methods disclosed in the Examples or other methods known to a skilled artisan. In some embodiments, a variant CD80 polypeptide is synthesized de novo utilizing protein or nucleic acid sequences available at any number of publicly available databases and then subsequently screened. The National Center for Biotechnology Information provides such information and its website is publicly accessible via the internet as is the UniProtKB database as discussed previously.

Unless stated otherwise, as indicated throughout the present disclosure, the amino acid substitution(s) are designated by amino acid position number corresponding to the numbering of positions of the unmodified ECD sequence set forth in SEQ ID NO:28 or also, where applicable, the unmodified IgV sequence contains residues 1-101 or 1-107, respectively, of SEQ ID NO:28 depending on annotation convention as follows:

(SEQ ID NO: 28)
VIHVTKEVKEVATLSCGHNVSVEELAQTRIYWQKEKKMVLTMMSGDMNIW
PEYKNRTIFDITNNLSIVILALRPSDEGTYECVVLKYEKDAFKREHLAEV

-continued

TLSVKADFPTPSISDFEIPTSNIRRIICSTSGGFPEPHLSWLENGEELNA

INTTVSQDPETELYAVSSKLDFNMTTNHSFMCLIKYGHLRVNQTFNWNTT

KQEHFPDN

Modifications provided herein can be in a wild-type or unmodified CD80 polypeptide set forth in SEQ ID NO: 28 or in a portion thereof contain an IgV domain or a specific binding fragment thereof. In some embodiments, the wild-type or unmodified CD80 polypeptide contains the IgV of CD80 as set forth in SEQ ID NO: 778, 983 or 984. In some embodiments, the unmodified CD80 polypeptide contains an IgV that can be several amino acids longer or shorter, such as 1-10, e.g. 1, 2, 3, 4, 5, 6 or 7 amino acids longer or shorter, than the sequence of amino acids set forth in SEQ ID NOs: 778, 983 or 984. In some embodiments, the unmodified CD80 polypeptide has 85%, 85%, 87%, 88%, 89%, 90%, 91%, 92%, 93%, 94%, 95%, 96%, 97%, 98%, 99% sequence identity to SEQ ID NO: 32, 805, or 806. In some embodiments, the unmodified CD80 polypeptide has the sequence set forth in any of SEQ ID NOs: 28, 778, 983 or 984.

(SEQ ID NO: 778)
VIHVTKEVKEVATLSCGHNVSVEELAQTRIYWQKEKKMVLTMMSGDMNIW

PEYKNRTIFDITNNLSIVILALRPSDEGTYECVVLKYEKDAFKREHLAEV

T (SEQ ID NO: 983)
VIHVTKEVKEVATLSCGHNVSVEELAQTRIYWQKEKKMVLTMMSGDMNIW

PEYKNRTIFDITNNLSIVILALRPSDEGTYECVVLKYEKDAFKREHLAEV

TLSV (SEQ ID NO: 984)
VIHVTKEVKEVATLSCGHNVSVEELAQTRIYWQKEKKMVLTMMSGDMNIW

PEYKNRTIFDITNNLSIVILALRPSDEGTYECVVLKYEKDAFKREHLAEV

TLSVKAD

It is within the level of a skilled artisan to identify the corresponding position of a modification, e.g. amino acid substitution, in a CD80 polypeptide, including portion thereof containing an IgSF domain (e.g. IgV) thereof, such as by alignment of a reference sequence with SEQ ID NO:28. In the listing of modifications throughout this disclosure, the amino acid position is indicated in the middle, with the corresponding unmodified (e.g. wild-type) amino acid listed before the number and the identified variant amino acid substitution listed after the number. If the modification is a deletion of the position a "del" is indicated and if the modification is an insertion at the position an "ins" is indicated.

In some embodiments, the variant CD80 polypeptide has one or more amino acid modifications (e.g., substitutions) in a wild-type or unmodified CD80 sequence. The one or more amino acid modifications (e.g., substitutions) can be in the ectodomain (extracellular domain) of the wild-type or unmodified CD80 sequence, such as the extracellular domain. In some embodiments, the one or more amino acid modifications (e.g., substitutions) are in the IgV domain or specific binding fragment thereof. In some embodiments, the one or more amino acid modifications (e.g., substitutions) are in the IgC domain or specific binding fragment thereof. In some embodiments of the variant CD80 polypeptide, some of the one or more amino acid modifications (e.g., substitutions) are in the IgV domain or a specific binding fragment thereof, and some of the one or more amino acid modifications (e.g., substitutions) are in the IgC domain or a specific binding fragment thereof.

In some embodiments, the variant CD80 polypeptide has up to 1, 2, 3, 4, 5, 6, 7, 8, 9, 10, 11, 12, 13, 14, 15, 16, 17, 18, 19, or 20 amino acid modifications (e.g., substitutions). The modifications (e.g., substitutions) can be in the IgV domain or the IgC domain. In some embodiments, the variant CD80 polypeptide has up to 1, 2, 3, 4, 5, 6, 7, 8, 9, 10, 11, 12, 13, 14, 15, 16, 17, 18, 19, or 20 amino acid modifications (e.g., substitutions) in the IgV domain or specific binding fragment thereof. In some embodiments, the variant CD80 polypeptide has up to 1, 2, 3, 4, 5, 6, 7, 8, 9, 10, 11, 12, 13, 14, 15, 16, 17, 18, 19, or 20 amino acid modifications (e.g., substitutions) in the IgC domain or specific binding fragment thereof. In some embodiments, the variant CD80 polypeptide has at least about 85%, 86%, 86%, 88%, 89%, 90%, 91%, 92%, 93%, 94%, 95%, 96%, 97%, 98%, or 99% sequence identity with the wild-type or unmodified CD80 polypeptide or specific binding fragment thereof, such as the amino acid sequence of SEQ ID NO: 28, 152, or 372.

In some embodiments, the variant CD80 polypeptide has one or more amino acid modifications (e.g., substitutions) in an unmodified CD80 or specific binding fragment there of corresponding to position(s) 4, 9, 10, 11, 12, 13, 14, 15, 16, 17, 18, 20, 21, 22, 24, 25, 27, 28, 29, 30, 31, 33, 36, 37, 38, 40, 41, 42, 43, 44, 47, 48, 50, 52, 53, 54, 59, 60, 61, 62, 63, 64, 65, 66, 67, 68, 69, 70, 72, 74, 76, 77, 80, 81, 83, 85, 86, 87, 88, 89, 90, 91, 92, 93, 94, 95, 96, 97, 99, 102, 103, 104, 107, 108, 109, 110, 114, 115, 116, 117, 118, 120, 121, 122, 126, 127, 128, 129, 130, 133, 137, 140, 142, 143, 144, 148, 149, 152, 154, 160, 162, 164, 168, 169, 174, 175, 177, 178, 183, 185, 188, 190, 192, 193, or 199 with reference to numbering of SEQ ID NO: 28. In some embodiments, such variant CD80 polypeptides exhibit altered binding affinity to one or more of CD28, PD-L1, or CTLA-4 compared to the wild-type or unmodified CD80 polypeptide. In some embodiments, such variant CD80 polypeptides exhibit altered binding affinity to one or more of human CD28, human PD-L1, and/or human CTLA-4 compared to the wild-type or unmodified CD80 polypeptide. For example, in some embodiments, the variant CD80 polypeptide exhibits increased binding affinity to CD28, PD-L1, and/or CTLA-4 compared to a wild-type or unmodified CD80 polypeptide. In some embodiments, the variant CD80 polypeptide exhibits increased binding affinity to human CD28 compared to a wild-type or unmodified CD80 polypeptide.

In some embodiments, the variant CD80 polypeptide has one or more amino acid substitution selected from V4M, K9E, E10R, V11S, A12G, A12T, A12V, T13N, L14A, S15V, S15F, C16S, C16G, C16L, G17W, H18L, H18R, H18Y, V20L, S21P, V22A, E24G, L25P, Q27R, T28A, T28S, R29C, R29D, R29H, R29V, I30V, Y31F, Y31H, Y31L, Q33H, K36E, K36G, K37E, K37Q, M38I, M38L, M38T, M38V, L40M, T41A, T41G, T41D, T41I, M42T, M43I, M43Q, M43R, M43V, S44P, M47T, N48D, N48I, W50G, E52G, Y53C, K54M, F59L, F59S, D60V, I61N, T62S, N63S, N64S, L65H, S66H, I67F, I67T, V68A, V68M, I69T, L70Q, L70P, L70R, L72P, P74L, D76G, E77G, E77K, Y80N, E81A, E81R, E81V, V83A, V83I, L85I, L85R, K86E, Y87N, E88D, E88G, K89E, K89N, K89R, D90K, D90L, D90N, A91E, A91G, A91S, A91T, F92L, F92N, F92P, F92Y, K93I, K93E, K93Q, K93R, K93V, R94G, R94L, R94F, E95K, H96R, L97R, E99D, E99G, L102S, S103L, S103P, V104A, V104L, D107N, F108L, P109S, P109H, T110A, S114T, D115G, F116S, F116L, E117V, E117G, I118V, I118A, I118T, T120S, S121P, N122S, I126L, I126V, I127T, C128Y, C128R, S129L, S129P, T130A, G133D, P137L, S140T, L142S, E143G, N144D, N144S, L148S, N149D, N149S, N152T, I154I, T154A, E160G, E162G, Y164H, S168G, K169E, K169I, K169S, M174T, M174V, T175A, N177S, H178R, L183H, K185E, H188D, H188Q, R190S, N192D, Q193L, or T199S. In some embodiments, the variant CD80 polypeptide has one or more amino acid substitutions selected from the group consisting of V4M, K9E, E10R, V11S, A12G, A12T, A12V, T13N, L14A, S15V, S15F, C16S, C16G, C16L, G17W, H18L, H18R, H18Y, V20L, S21P, V22A, E24G, L25P, Q27R, T28A, T28S, R29C, R29D, R29H, R29V, I30V, Y31F, Y31H, Y31L, Q33H, K36E, K36G, K37E, K37Q, M38I, M38L, M38T, M38V, L40M, T41A, T41G, T41D, I41I, M42T, M43I, M43Q, M43R, M43V, S44P, M47T, N48D, N48I, W50G, E52G, Y53C, K54M, F59L, F59S, D60V, I61N, T62S, N63S, N64S, L65H, S66H, I67F, I67I, V68A, V68M, I69I, L70Q, L70P, L70R, L72P, P74L, D76G, E77G, E77K, Y80N, E81A, E81R, E81V, V83A, V83I, L85I, L85R, K86E, Y87N, E88D, E88G, K89E, K89N, K89R, D90K, D90L, D90N, A91E, A91G, A91S, A91T, F92N, F92N, F92P, F92Y, K93I, K93E, K93Q, K93R, K93V, R94R, R94L, R94F, E95K, H96R, L97R, E99D, E99G, L102S, S103L, S103P, V104A, V104L, D107N, F108L, P109S, P109H, T110A, S114T, D115G, F116S, F116L, E117V, E117G, I118V, I118A, I118T, T120S, S121P, N122S, I126L, I126V, I127T, C128Y, C128R, S129L, S129P, T130A, G133D, P137L, S140T, L142S, E143G, N144D, N144S, L148S, N149D, N149S, N152T, I154I, T154A, E160G, E162G, Y164H, S168G, K169E, K169I, K169S, M174T, M174V, T175A, N177S, H178R, L183H, K185E, H188D, H188Q, R190S, N192D, Q193L, T199S or a conservative amino acid substitution thereof.

In some embodiments, the one or more amino acid modification, e.g. substitution is L70Q/A91G, L70Q/A91G/T130A, L70Q/A91G/I118A/T120S/T130A, V4M/L70Q/A91G/T120S/T130A, L70Q/A91G/T120S/T130A, V20L/L70Q/A91S/T120S/T130A, S44P/L70Q/A91G/T130A, L70Q/A91G/E117G/T120S/T130A, A91G/T120S/T130A, L70R/A91G/T120S/T130A, L70Q/E81A/A91G/T120S/I127T/T130A, L70Q/Y87N/A91G/T130A, T28S/L70Q/A91G/E95K/T120S/T130A, N63S/L70Q/A91G/T120S/T130A, K36E/I67T/L70Q/A91G/T120S/T130A/N152T, E52G/L70Q/A91G/T120S/T130A, K37E/F59S/L70Q/A91G/T120S/T130A, A91G/S103P, K89E/T130A, D60V/A91G/T120S/T130A, K54M/A91G/T120S, M38T/L70Q/E77G/A91G/T120S/T130A/N152T, R29H/E52G/L70R/E88G/A91G/T130A, Y31H/T41G/L70Q/A91G/T120S/T130A, V68A/T110A, S66H/D90G/T110A/F116L, R29H/E52G/T120S/T130A, A91G/L102S, I67T/L70Q/A91G/T120S, L70Q/A91G/T110A/T120S/T130A, M38V/T41D/M43I/W50G/D76G/V83A/K89E/T120S/T130A, V22A/L70Q/S121P, A12V/S15F/Y31H/T41G/T130A/P137L/N152T, I67F/L70R/E88G/A91G/T120S/T130A, E24G/L25P/L70Q/T120S, A91G/F92L/F108L/T120S, R29D/Y31L/Q33H/K36G/M38I/T41A/M43R/M47T/E81V/L85R/K89N/A91T/F92P/K93V/R94L/I118T/N149S, R29D/Y31L/Q33H/K36G/M38I/T41A/M43R/M47T/E81V/L85R/K89N/A91T/F92P/K93V/R94L/N144S/N149S, R29D/Y31L/Q33H/K36G/M38I/T41A/M42T/M43R/M47T/E81V/L85R/K89N/A91T/F92P/K93V/R94L/L148S/N149S, E24G/R29D/Y31L/Q33H/K36G/M38I/T41A/M43R/M47T/F59L/E81V/L85R/K89N/A91T/F92P/K93V/R94L/H96R/N149S/C182S, R29D/Y31L/Q33H/K36G/M38I/T41A/M43R/M47T/E81V/L85R/K89N/A91T/F92P/K93V/R94L/N149S, R29V/M43Q/E81R/L85I/K89R/D90L/A91E/F92N/K93Q/R94G, T41I/A91G, K89R/D90K/A91G/F92Y/K93R/N122S/N177S, K89R/D90K/A91G/F92Y/K93R, K36G/K37Q/M38I/F59L/E81V/L85R/K89N/A91T/F92P/K93V/R94L/E99G/T130A/N149S, E88D/K89R/D90K/A91G/F92Y/K93R, K36G/K37Q/M38I/L40M, R29H/Y31H/T41G/Y87N/E88G/K89E/D90N/A91G/P109S, A12T/H18L/M43V/F59L/E77K/P109S/I118T, R29V/Y31F/K36G/M38L/M43Q/E81R/V83I/L85I/K89R/D90L/A91E/F92N/K93Q/R94G, V68M/L70P/L72P/K86E, R29D/Y31L/Q33H/K36G/M38I/T41A/M43R/M47T/E81V/L85R/K89N/A91T/F92P/K93V/R94L/T120S/I127T/T130A/K169E, R29D/Y31L/Q33H/K36G/M38I/T41A/M43R/M47T/L70Q/E81V/L85R/K89N/A91T/F92P/K93V/R94L/T120S/I127T/T130A, H18L/R29D/Y31L/Q33H/K36G/M38I/T41A/M43R/M47T/E81V/L85R/K89N/A91T/F92P/K93V/R94L/T120S/I127T/T130A/K169E, R29D/Y31L/Q33H/K36G/M38I/T41A/M43R/M47T/E81V/L85R/K89N/A91T/F92P/K93V/R94L/T120S/T130A/M174T, R29D/Y31L/Q33H/K36G/M38I/T41A/M43R/M47T/F59L/E81V/L85R/K89N/A91T/F92P/K93V/R94L/T120S/I127T/T130A/H188D, H18R/R29D/Y31L/Q33H/K36G/K37E/M38I/T41A/M43R/M47T/L70Q/E81V/L85R/K89N/A91T/F92P/K93V/R94L/T120S/T130A/K169E/H188D, R29D/Y31L/Q33H/K36G/M38I/T41A/M43R/M47T/L70Q/E81V/L85R/K89N/A91T/F92P/K93V/R94L/T120S/I127T/T130A/E143G/K169E/M174V/H188D, R29D/Y31L/Q33H/K36G/M38I/T41A/M43R/M47T/L70Q/E81V/L85R/K89N/A91T/F92P/K93V/R94L/T120S/I127T/T130A, R29D/Y31L/Q33H/K36G/M38I/T41A/M43R/M47T/E81V/L85R/K89N/A91T/F92P/K93V/R94L/T120S/I127T/T130A/H188D, R29D/Y31L/Q33H/K36G/M38I/T41A/M43R/M47T/L70Q/E81V/L85R/K89N/A91T/F92P/K93V/R94L/T120S/I127T/T130A/K169E, R29D/Y31L/Q33H/K36G/M38I/T41A/M43R/M47T/L70Q/E81V/L85R/K89N/A91T/F92P/K93V/R94L/T120S/I127T/T130A, R29D/Y31L/Q33H/K36G/M38I/T41A/M43R/M47T/L85R/K89N/A91T/F92P/K93V/R94L/T120S/I127T/T130A/K169E/H188D, R29D/Y31L/Q33H/K36G/M38I/T41A/M43R/M47T/E81V/L85R/K89N/A91T/F92P/K93V/R94L/F108L/T120S/T130A/K169E/H188D, R29D/Y31L/Q33H/K36G/M38I/T41A/M43R/M47T/L70Q/E81V/L85R/K89N/A91T/F92P/K93V/R94L/T130A/H188D, R29D/Y31L/Q33H/K36G/M38I/T41A/M43R/M47T/L70Q/E81V/L85R/K89N/A91T/F92P/K93V/R94L/T120S/I127T/T130A/K169E, H18L/R29D/Y31L/Q33H/K36G/M38I/T41A/M43R/M47T/L70Q/E81V/L85R/K89N/A91T/F92P/K93V/R94L/T120S/T130A/K169E/H188D, R29D/Y31L/Q33H/K36G/M38I/T41A/M43R/M47T/E81V/L85R/K89N/A91T/F92P/K93V/R94L/T120S/I127T/C128Y/T130A/H188D, R29D/Y31L/Q33H/K36G/M38I/T41A/M43R/M47T/E81V/L85R/K89N/A91T/F92P/K93V/R94F/T130A/K169E, H18L/R29D/Y31L/Q33H/K36G/M38I/T41A/M43R/M47T/E81V/L85R/K89N/A91T/F92P/K93V/R94L/T130A, H18L/R29D/Y31L/Q33H/K36G/M38I/T41A/M43R/M47T/L70Q/E81V/L85R/K89N/A91T/F92P/K93V/R94L/T120S/T130A/K169E, R29D/Y31L/Q33H/K36G/M38I/T41A/M43R/M47T/L70Q/E81V/L85R/K89N/A91T/F92P/K93I/R94L/L 97R/T130A, R29D/Y31L/Q33H/K36G/M38I/T41A/M43R/M47T/L70Q/E81V/L85R/K89N/A91T/F92P/K93I/R94L/L 97R/T130A/L148S, H18L/R29D/Y31L/Q33H/K36G/M38I/T41A/M43R/M47T/E81V/L85R/K89N/A91T/F92P/K93V/R94L/I118V/T120S/I127T/T130A/K169E, R29D/Y31L/Q33H/K36G/M38I/T41A/M43R/M47T/I61N/E81V/L85R/K89N/A91T/F92P/K93V/R94F/V104A/T120S/T130A, R29D/Y31L/Q33H/K36G/M38I/T41A/M43R/M47T/E81V/L85R/K89N/F92P/

K93V/R94F/I118V/T130A M38I/T41A/M43R/M47T/T62S/E81V/L85R/K89N/A91T/ F92P/K93V/R94L/I118V/T120S/T130A/K169E/T175A, H18L/R29D/Y31L/Q33H/K36G/M38I/T41A/M43R/ M47T/E81V/L85R/K89N/A91T/F92P/K93V/R94L/F116S/ T130A/H188D, H18L/R29D/Y31L/Q33H/K36G/M38I/ T41A/M43R/M47T/E81V/L85R/K89N/A91T/F92P/K93V/ R94L/T120S/I127T/T130A/L142S/H188D, C16S/H18L/ R29D/Y31L/Q33H/K36G/M38I/T41A/M43R/M47T/ E81V/L85R/K89N/A91T/F92P/K93V/R94L/T110A/ H188D, R29D/Y31L/Q33H/K36G/M38I/T41A/M43R/ M47T/A91G/T120S/I127T/T130A/H188D, R29D/Y31L/ Q33H/K36G/M38I/T41A/M43R/M47T/L70Q/D76G/ A91G/S103L/T120S/I127T/T130A, DELTAQ33/Y53C/ L85R/K89N/A91T/F92P/K93V/R94L/T120S/I127T/ T130A/K169E, T62S/E81V/L85R/K89N/A91T/F92P/ K93V/R94L/T120S/T130A/K169E, R29D/Y31L/Q33H/ K36G/M38I/T41A/M43R/M47T/E81V/L85R/K89N/A91T/ F92P/K93V/R94L/S129L/H188D, K9E/E10R/V11S/A12G/ T13N/K14A/S15V/C16L/G17W/H18Y/Y53C/L70Q/ D90G/T130A/N149D/N152T/H188D, H18L/R29D/Y31L/ Q33H/K36G/T41A/M43R/M47T/E81V/L85R/K89N/ A91T/F92P/K93V/R94L/I118V/T120S/I127T/T130A/ H188D, K89E/K93E/T130A, S21P/R29D/Y31L/Q33H/ K36G/M38I/T41A/M43R/M47T/N48I/V68A/E81V/L85R/ K89N/A91T/F92P/K 93V/R94L/P109H/I126L/K169I, H18L/R29D/Y31L/Q33H/K36G/M38I/T41A/M43R/ M47T/P74L/Y80N/E81V/L85R/K89N/A91T/F92P/K93V/ R94L/L97R, S21P/R29D/Y31L/Q33H/K36G/M38I/T41A/ M43R/M47T/P74L/Y80N/E81V/L85R/K89N/D90N/A91T/ F92P/K93V/R94L/T130A/N149S/E162G, H18L/R29D/ Y31L/Q33H/K36G/M38I/T41A/M43R/M47T/V68M/ E81V/L85R/K89N/A91T/F92P/K93V/R94L/T130A, R29D/Y31L/Q33H/K36G/M38I/T41A/M43R/M47T/ V68M/E81V/L85R/K89N/A91T/F92P/K93V/R94L/ T130A/N149S/R190S, H18L/R29D/Y31L/Q33H/K36G/ M38I/T41A/M43R/M47T/P74L/Y80N/E81V/L85R/K89N/ A91T/F92P/K93V/R94L/T130A/R190S, C16G/V22A/ R29D/Y31L/Q33H/K36G/M38I/T41A/M43R/M47T/ V68M/D76G/E81V/L85R/K89N/A91T/F92P/K93V/R94L/ I118T/T130A/S140T/N149S/K169I/H178R/N192D, R29D/ Y31L/Q33H/K36G/M38I/T41A/M43R/M47T/E81V/L85R/ K89N/A91T/F92P/K93V/R94F/E117V/I118T/N149S/ S168G/H188Q, V22A/R29D/Y31L/Q33H/K36G/M38I/ T41A/M43R/M47T/V68M/E81V/L85R/K89N/A91T/F92P/ K93V/R94L/T130A, R29D/Y31L/Q33H/K36G/M38I/ T41A/M43R/M47T/N64S/E81V/L85R/K89N/A91T/F92P/ K93V/R94F/I118T/T130A/N149S/K169I, V22A/R29D/ Y31L/Q33H/K36G/M38I/T41A/M43R/M47T/V68M/ E81V/L85R/K89N/A91T/F92P/K93V/R94L/D115G/ I118T/T130A/G133D/N149S, S129P, A91G/S129P, I69T/ L70Q/A91G/T120S, Y31H/S129P, T28A/R29D/Y31L/ Q33H/K36G/M38I/T41A/M43R/M47T/E81V/L85R/ K89N/A91T/F92P/K93V/R94L/V104T/T130A/N149S, H18L/R29D/Y31L/Q33H/K36G/M38I/T41A/M43R/ M47T/E81V/L85R/K89N/A91T/F92P/K93V/R94L/L97R/ N149S/H188Q, H18L/R29D/Y31L/Q33H/K36G/M38I/ T41A/M43R/M47T/E81V/L85R/K89N/A91T/F92P/K93V/ R94L/L97R/N149S, H18L/R29D/Y31L/Q33H/K36G/ M38I/T41A/M43R/M47T/V68A/E81V/L85R/K89N/A91T/ F92P/K93V/R94L/T130A/N149S/T154I, A12G/R29D/ Y31L/Q33H/K36G/M38I/T41A/M43R/M47T/V68A/ E81V/L85R/K89N/A91T/F92P/K93V/R94L/L97R/T130A/ L183H, R29D/Y31L/Q33H/K36G/M38I/T41A/M43R/ M47T/E81V/L85R/K89N/A91T/F92P/K93V/R94L/I118T/ T130A/S140T/N149S/K169S, R29D/Y31L/Q33H/K36G/ M38I/T41A/M43R/M47T/E81V/L85R/K89N/A91T/F92P/ K93V/R94L/I118T/T130A/N149S/K169I/Q193L, V22A/ R29D/Y31L/Q33H/K36G/M38I/T41A/M43R/M47T/ E81V/L85R/K89N/A91T/F92P/K93V/R94L/I118T/T130A/ N149S, R29D/Y31L/Q33H/K36G/M38I/T41A/M43R/ M47T/E81V/L85R/K89N/A91T/F92P/K93V/R94L/I118T/ T130A/N149S, R29D/Y31L/Q33H/K36G/M38I/T41A/ M43R/M47T/E81V/L85R/K89N/A91T/F92P/K93V/R94L/ I118T/T130A/N149S/K169I, R29D/Y31L/Q33H/K36G/ M38I/T41A/M43R/M47T/E81V/L85R/K89N/A91T/F92P/ K93V/R94F/T130A/N149S/K169I, I118T/C128R, Q27R/ R29C/M42T/S129P/E160G, S129P/T154A, S21P/L70Q/ D90G/T120S/T130A, L70Q/A91G/N144D, L70Q/A91G/ I118A/T120S/T130A/K169E, V4M/L70Q/A91G/I118V/ T120S/T130A/K169E, L70Q/A91G/I118V/T120S/T130A/ K169E, L70Q/A91G/I118V/T120S/T130A, V20L/L70Q/ A91S/I118V/T120 S/T130A, L70Q/A91G/E117G/I118V/ T120S/T130A, A91G/I118V/T120S/T130A, L70R/A91G/ I118V/T120S/T130A/T199S, L70Q/E81A/A91G/I118V/ T120S/I127T/T130A, T28S/L70Q/A91G/E95K/I118V/ T120S/I126V/T130A/K169E, N63 S/L70Q/A91G/S114T/ I118V/T120S/T130A, K36E/I67T/L70Q/A91G/I118V/ T120S/T130A/N152T, E52G/L70Q/A91G/D107N/I118V/ T120S/T130A/K169E, K37E/F59S/L70Q/A91G/I118V/ T120S/T130A/K185E, D60V/A91G/I118V/T120S/T130A/ K169E, K54M/L70Q/A91G/Y164H/T120S, M38T/L70Q/ E77G/A91G/I118V/T120S/T130A/N152T, Y31H/T41G/ M43L/L70Q/A91G/I118V/T120S/I126V/T130A, L65H/ D90G/T110A/F116L, R29H/E52G/D90N/I118V/T120S/ T130A, I67T/L70Q/A91G/I118V/T120S, L70Q/A91G/ T110A/I118V/T120S/T130A, M38V/T41D/M43I/W50G/ D76G/V83A/K89E/I118V/T120S/I126V/T130A, A12V/ S15F/Y31H/M38L/T41G/M43L/D90N/T130A/P137L/N149D/N152T, 167F/L70R/E88G/A91G/I118V/T120S/T130A, E24G/L25P/L70Q/A91G/I118V/T120S/N152T, A91G/F92L/F108L/I118V/T120S, E88D/K89R/D90K/A91G/F92Y/K93R/N122S/N177S, K36G/K37Q/M38I/L40M/F59L/E81V/L85R/K89N/A91T/F92P/K93V/R94L/E99G/T130A/N149S, K36G/L40M, R29D/Y31L/Q33H/K36G/M38I/T41A/M43R/M47T/E81V/L85R/K89N/A91T/F92P/K93V/R94L/I118V/T120S/I127T/T130A/K169E, R29D/Y31L/Q33H/K36G/M38I/T41A/M43R/M47T/L70Q/E81V/L85R/K89N/A91T/F92P/K93V/R94L/I118V/T120S/I127T/T130A, H18L/R29D/Y31L/Q33H/K36G/M38I/T41A/M43R/M47T/E81V/L85R/K89N/A91T/F92P/K93V/R94L/I118V/T120S/I127T/T130A/K169E, R29D/Y31L/Q33H/K36G/M38I/T41A/M43R/M47T/E81V/L85R/K89N/A91T/F92P/K93V/R94L/I118V/T120S/T130A/K169E/M174T, R29D/Y31L/Q33H/K36G/M38I/T41A/M43R/M47T/N48D/F59L/E81V/L85R/K89N/A91T/F92P/K93V/R94L/I118V/T120S/I127T/T130A/H188D, H18R/R29D/Y31L/Q33H/K36G/K37E/M38I/T41A/M43R/M47T/L70Q/E81V/L85R/K89N/A91T/F92P/K93V/R94L/I118V/T120S/T130A/K169E/H188D, R29D/Y31L/Q33H/K36G/M38I/T41A/M43R/M47T/L70Q/E81V/L85R/K89N/A91T/F92P/K93V/R94L/I118V/T120S/I127T/T130A/E143G/K169E/M174V/H188D, R29D/I30V/Y31L/Q33H/K36G/M38I/T41A/M43R/M47T/E81V/L85R/K89N/A91T/F92P/K93V/R94L/I118V/T120S/I127T/T130A/H188D, R29D/Y31L/Q33H/K36G/M38I/T41A/M43R/M47T/E81V/L85R/K89N/A91T/F92P/K93V/R94L/I118V/T120S/I127T/T130A/H188D, R29D/Y31L/Q33H/K36G/M38I/T41A/M43R/M47T/L70Q/E81V/L85R/K89N/A91T/F92P/K93V/R94L/I118V/T120S/I127T/T130A/K169E, R29D/Y31L/Q33H/K36G/M38I/T41A/M43R/M47T/L70Q/E81V/K89N/A91T/F92P/K93V/R94L/I118V/T120S/I127T/T130A, R29D/Y31L/Q33H/K36G/M38I/T41A/M43R/M47T/L85R/K89N/A91T/F92P/K93V/R94L/I118V/

T120S/I127T/T130A/K169E/H188D, R29D/Y31L/Q33H/
K36G/M38I/T41A/M43R/M47T/E81V/L85R/K89N/A91T/
F92P/K93V/R94L/F108L/I118V/T120S/T130A/K169E/
H188D, R29D/Y31L/Q33H/K36G/M38I/T41A/M43R/
M47T/L70Q/E81V/L85R/K89N/A91T/F92P/K93V/R94L/
I118V/T120S/T130A/N149D/K169E/H188D, H18L/R29D/
Y31L/Q33H/K36G/M38I/T41A/M43R/M47T/L70Q/E81V/
L85R/K89N/A91T/F92P/K93V/R94L/I118V/T120S/
T130A/K169E/H188D, R29D/Y31L/Q33H/K36G/M38I/
T41A/M43R/M47T/E81V/L85R/K89N/A91T/F92P/K93V/
R94L/I118V/T120S/I127T/C128Y/T130A/H188D, H18L/
R29D/Y31L/Q33H/K36G/M38I/T41A/M43R/M47T/
E81V/L85R/K89N/A91T/F92P/K93V/R94L/E99D/T130A,
H18L/R29D/Y31L/Q33H/K36G/M38I/T41A/M43R/
M47T/L70Q/E81V/L85R/K89N/A91T/F92P/K93V/R94L/
I118V/T120S/T130A/K169E, R29D/Y31L/Q33H/K36G/
M38I/T41A/M43R/M47T/I61N/E81V/L85R/K89N/A91T/
F92P/K93V/R94F/V104A/I118V/T120S/I126V/T130A,
R29D/Y31L/Q33H/K36G/M38I/T41A/M43R/M47T/
E81V/L85R/K89N/A91T/F92P/K93V/R94F/I118V/T120S/
T130A, R29D/Y31L/Q33H/K36G/M38I/T41A/M43R/
M47T/T62S/E81V/L85R/K89N/A91T/F92P/K93V/R94L/
I118V/T120S/T130A/K169E/T175A, H18L/R29D/Y31L/
Q33H/K36G/M38I/T41A/M43R/M47T/E81V/L85R/
K89N/A91T/F92P/K93V/R94L/I118V/T120S/I127T/
T130A/L142S/H188D, C16S/H18L/R29D/Y31L/Q33H/
K36G/M38I/T41A/M43R/M47T/E81V/L85R/K89N/A91T/
F92P/K93V/R94L/T110A/I118V/H188D, R29D/Y31L/
Q33H/K36G/M38I/T41A/M43R/M47T/A91G/I118V/
T120S/I127T/T130A/H188D, R29D/Y31L/Q33H/K36G/
M38I/T41A/M43R/M47T/L70Q/D76G/A91G/S103L/
I118V/T120S/I127T/T130A, Y53C/L85R/K89N/A91T/
F92P/K93V/R94L/I118V/T120S/I127T/T130A/K169E,
T62S/E81V/L85R/K89N/A91T/F92P/K93V/R94L/I118V/
T120S/T130A/K169E, Y53C/L70Q/D90G/T130A/N149D/
N152T/H188D, H18L/R29D/Y31L/Q33H/K36G/M38I/
T41A/M43R/M47T/E81V/L85R/K89N/A91T/F92P/K93V/
R94L/I118V/T120S/I127T/T130A/H188D, H18L/R29D/
Y31L/Q33H/K36G/M38I/T41A/M43R/M47T/E81V/L85R/
K89N/A91T/F92P/K93V/R94L/T130A/N149S.

In some embodiments, the variant CD80 polypeptide exhibits increased binding affinity to CD28 (e.g. human CD28) compared to a wild-type or unmodified CD80 polypeptide. In some embodiments, the variant CD80 polypeptide has one or more amino acid modifications (e.g., substitutions) in an unmodified CD80 or specific binding fragment there of corresponding to position(s) 36, 40, 41, 63, 69, 70, 81, 88, 89, 90, 91, 92, 93, 114, 117, 118, 120, 122, 127, 130, 144, 169, 178, or 199. In some embodiments, the variant CD80 polypeptide has one or more amino acid substitution selected from K36G, L40M, T41I, N63S, I69T, L70Q, L70R, E81A, E88D, K89R, D90K, A91G, F92Y, K93R, S114T, E117G, I118A, I118V, T120S, N122S, I127T, T130A, N144D, K169E, N178S, or T199S, or a conservative amino acid substitution thereof. In some embodiments, the one or more amino acid modification, e.g. substitution is L70Q/A91G/N144D, L70Q/A91G/I118A/T120S/T130A/K169E, L70Q/A91G/E117G/I118V/T120S/T130A, L70R/A91G/I118V/T120S/T130A/T199S, L70Q/E81A/A91G/I118V/T120S/I127T/T130A, N63S/L70Q/A91G/S114T/I118V/T120S/T130A, T41I/A91G, E88D/K89R/D90K/A91G/F92Y/K93R/N122S/N178S, E88D/K89R/D90K/A91G/F92Y/K93R, E88D/K89R/D90K/A91G/F92Y/K93R, K36G/L40M, or 169T/L70Q/A91G/T120S.

3. CD86

In some embodiments, the at least one additional (e.g., second or third) vIgD is an IgSF domain (e.g. IgV) of a variant CD86 polypeptide that contains one or more amino acid modifications (e.g., substitutions, deletions or additions) in the IgSF domain (e.g., IgV) compared to unmodified or wild-type CD86. In some embodiments, the IgSF domain of CD86 comprises an IgV domain or an IgC (e.g. IgC2) domain or specific binding fragment of the IgV domain or the IgC (e.g. IgC2) domain, or combinations thereof. In some embodiments, the IgD can be an IgV only, the combination of the IgV and IgC, including the entire extracellular domain (ECD), or any combination of Ig domains of CD86. In some embodiments, the wild-type or unmodified CD86 polypeptide has (i) the sequence of amino acids set forth in SEQ ID NO: 2 or a mature form thereof lacking the signal sequence, (ii) a sequence of amino acids that exhibits at least about 85%, 86%, 87%, 88%, 89%, 90%, 91%, 92%, 93%, 94%, 95%, 96%, 97%, 98%, 99% sequence identity to SEQ ID NO: 2 or a mature form thereof, or (iii) is a portion of (i) or (ii) containing an IgV domain or IgC domain or specific binding fragments thereof. In some embodiments, the wild-type or unmodified CD86 polypeptide has (i) the sequence of amino acids set forth in SEQ ID NO: 29, (ii) a sequence of amino acids that exhibits at least about 85%, 86%, 87%, 88%, 89%, 90%, 91%, 92%, 93%, 94%, 95%, 96%, 97%, 98%, 99% sequence identity to SEQ ID NO: 29, or (iii) is a portion of (i) or (ii) containing an IgV domain or IgC domain or specific binding fragments thereof. In some embodiments, the wild-type or unmodified CD86 polypeptide has (i) the sequence of amino acids set forth in SEQ ID NO: 1100, (ii) a sequence of amino acids that exhibits at least about 85%, 86%, 87%, 88%, 89%, 90%, 91%, 92%, 93%, 94%, 95%, 96%, 97%, 98%, 99% sequence identity to SEQ ID NO: 1100, or (iii) is a portion of (i) or (ii) containing an IgV domain or IgC domain or specific binding fragments thereof. In some embodiments, the wild-type or unmodified CD86 polypeptide has (i) the sequence of amino acids set forth in SEQ ID NO: 1104, (ii) a sequence of amino acids that exhibits at least about 85%, 86%, 87%, 88%, 89%, 90%, 91%, 92%, 93%, 94%, 95%, 96%, 97%, 98%, 99% sequence identity to SEQ ID NO: 1104, or (iii) is a portion of (i) or (ii) containing an IgV domain or IgC domain or specific binding fragments thereof.

In some embodiments, the IgSF domain of CD86 is a variant CD86 polypeptide containing at least one affinity-modified IgSF domain (e.g. IgV or IgC) or a specific binding fragment thereof is an IgSF domain contained in a wild-type or unmodified CD86 polypeptide such that the variant CD86 polypeptide exhibits altered (increased or decreased) binding activity or affinity for CD28 compared to a wild-type or unmodified CD86 polypeptide. In some embodiments, the variant CD86 polypeptides containing at least one affinity-modified IgSF domain (e.g., IgV) or a specific binding fragment thereof relative to an IgSF domain contained in a wild-type or unmodified CD86 polypeptide such that the variant CD86 polypeptide exhibits altered (increased or decreased) binding activity or affinity for one or more ligands CD28 or CTLA-4 compared to a wild-type or unmodified CD86 polypeptide. In some embodiments, a variant CD86 polypeptide has a binding affinity for CD28 that differs from that of a wild-type or unmodified CD86 polypeptide control sequence as determined by, for example, solid-phase ELISA immunoassays, flow cytometry or Biacore assays. In some embodiments, a variant CD86 polypeptide has a binding affinity for CD28 and/or CTLA-4 that differs from that of a wild-type or unmodified CD86 polypeptide control sequence as determined by, for example, solid-phase ELISA immunoassays, flow cytometry, ForteBio Octet or Biacore assays.

In some embodiments, the variant CD86 polypeptide has an increased binding affinity for CD28, relative to a wild-type or unmodified CD86 polypeptide. In some embodiments, the variant CD86 polypeptide has a decreased binding affinity for CTLA-4, relative to a wild-type or unmodified CD86 polypeptide. In some embodiments, the variant CD86 polypeptide exhibits no change in binding affinity for CTLA-4, relative to a wild-type or unmodified CD86 polypeptide. In some embodiments, the variant CD86 polypeptide exhibits no increase in binding affinity for CTLA-4, relative to a wild-type or unmodified CD86 polypeptide. In some embodiments, the variant, wild-type, and unmodified CD86 polypeptides bind to the ectodomain of CD28 and/or CTLA-4. Thus, in some embodiments, affinity or binding activity is determined with respect to the binding of variant, wild-type, and unmodified CD86 polypeptides to the ectodomain of CD28 and/or CTLA-4.

The CD28 can be a mammalian protein, such as a human protein or a murine protein. In some embodiments, the CD28 is a human protein.

Binding affinities for each of the cognate binding partners are independent; that is, in some embodiments, a variant CD86 polypeptide has an increased binding affinity for CD28 but not CTLA-4, relative to a wild-type or unmodified CD86 polypeptide.

In some embodiments, the variant CD86 polypeptide has an increased binding affinity for CD28, relative to a wild-type or unmodified CD86 polypeptide and has a decreased binding affinity for CTLA-4, relative to a wild-type or unmodified CD86 polypeptide. In some embodiments, the variant CD86 polypeptide has an increased binding affinity for CD28, relative to a wild-type or unmodified CD86 polypeptide and has no change in binding affinity for CTLA-4, relative to a wild-type or unmodified CD86 polypeptide.

In some embodiments, the variant CD86 polypeptide has an increased binding affinity for CD28, relative to a wild-type or unmodified CD86 polypeptide. In some embodiments, a variant CD86 polypeptide with increased or greater binding affinity to CD28 will have an increase in binding affinity relative to the wild-type or unmodified CD86 polypeptide control of at least about 5%, such as at least about 10%, 15%, 20%, 25%, 35%, or 50% for the CD28. In some embodiments, the increase in binding affinity relative to the wild-type or unmodified CD86 polypeptide is more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. In some embodiments, the increase in binding affinity relative to the wild-type or unmodified CD86 polypeptide is more than 1.2-fold, 1.5-fold, 2-fold, 3-fold, 4-fold, 5-fold, 6-fold, 7-fold, 8-fold, 9-fold, 10-fold, 20-fold, 30-fold 40-fold, 50-fold, 60-fold, 70-fold, 80-fold, 90-fold, 100-fold, 125-fold, 150-fold, 175-fold, 200-fold, 225-fold, 250-fold, 275-fold, 300-fold, 325-fold, 350-fold 375-fold, or 400-fold. In such examples, the wild-type or unmodified CD86 polypeptide has the same sequence as the variant CD86 polypeptide except that it does not contain the one or more amino acid modifications (e.g. substitutions).

In some embodiments, the variant CD86 polypeptide has a decreased binding affinity for CTLA-4, relative to a wild-type or unmodified CD86 polypeptide. In some embodiments, a variant CD86 polypeptide with reduced or decreased binding affinity to CTLA-4 will have a decrease in binding affinity relative to the wild-type or unmodified CD86 polypeptide control of at least 5%, such as at least about 10%, 15%, 20%, 30%, 40%, 50%, 60%, 70%, 80%, 90% or more for the CTLA-4. In some embodiments, the decrease in binding affinity relative to the wild-type or unmodified CD86 polypeptide is more than 1.1-fold, 1.2-fold, 1.3-fold, 1.4-fold, 1.5-fold, 1.6-fold, 1.7-fold, 1.8-fold, 1.9-fold, 2-fold, 3-fold, 4-fold, 5-fold, 6-fold, 7-fold, 8-fold, 9-fold, 10-fold, 20-fold, 30-fold 40-fold or 50-fold. In some embodiments, a variant CD86 polypeptide does not show a change in binding affinity to CTLA-4 relative to the wild-type or unmodified CD86 polypeptide control. In some embodiments, a variant CD86 polypeptide does not show an increase in binding affinity to CTLA-4 relative to the wild-type or unmodified CD86 polypeptide control. In such examples, the wild-type or unmodified CD86 polypeptide has the same sequence as the variant CD86 polypeptide except that it does not contain the one or more amino acid modifications (e.g. substitutions).

In some embodiments, the equilibrium dissociation constant ($K_d$) of any of the foregoing embodiments to CD28 can be less than $1\times10^{-5}$M, $1\times10^{-6}$ M, $1\times10^{-7}$ M, $1\times10^{-8}$M, $1\times10^{-9}$ M, $1\times10^{-10}$ M or $1\times10^{-11}$M, or $1\times10^{-12}$ M. In some embodiments, the equilibrium dissociation constant ($K_d$) of any of the foregoing embodiments to CTLA-4 can be less than $1\times10^{-5}$ M, $1\times10^{-6}$ M, $1\times10^{-7}$ M, $1\times10^{-8}$M, $1\times10^{-9}$M, $1\times10^{-10}$ M or $1\times10^{-11}$M, or $1\times10^{-12}$ M.

In some embodiments, a variant CD86 polypeptide has an increased or greater binding affinity to CD28. In some embodiments, a variant CD86 polypeptide with increased or greater binding affinity to CD28 will have an increase in binding affinity relative to the wild-type or unmodified CD86 polypeptide control of at least about 25%, such as at least about 30%, 40%, 50%, or 60% for CD28. In some embodiments, a variant CD86 polypeptide with increased or greater binding affinity to CD28 has an equilibrium dissociation constant ($K_d$) of less than 200 pM, 300 pM, 400 pM, 500 pM, or 600 pM for CD28. In some embodiments, the variant polypeptide specifically binds to the ectodomain of CD28 with increased selectivity compared to the unmodified CD86. In some embodiments, the increased selectivity is for CD28.

The wild-type or unmodified CD86 sequence does not necessarily have to be used as a starting composition to generate variant CD86 polypeptides described herein. Therefore, use of the term "modification", such as "substitution" does not imply that the present embodiments are limited to a particular method of making variant CD86 polypeptides. Variant CD86 polypeptides can be made, for example, by de novo peptide synthesis and thus does not necessarily require a modification, such as a "substitution", in the sense of altering a codon to encode for the modification, e.g. substitution. This principle also extends to the terms "addition" and "deletion" of an amino acid residue which likewise do not imply a particular method of making. The means by which the variant CD86 polypeptides are designed or created is not limited to any particular method. In some embodiments, however, a wild-type or unmodified CD86 encoding nucleic acid is mutagenized from wild-type or unmodified CD86 genetic material and screened for desired specific binding affinity and/or induction of IFN-gamma expression or other functional activity. In some embodiments, a variant CD86 polypeptide is synthesized de novo utilizing protein or nucleic acid sequences available at any number of publicly available databases and then subsequently screened. The National Center for Biotechnology Information provides such information and its website is publicly accessible via the internet as is the UniProtKB database as discussed previously.

Unless stated otherwise, as indicated throughout the present disclosure, the amino acid substitution(s) are designated by amino acid position number corresponding to the numbering of positions of the unmodified ECD sequence set forth in SEQ ID NO: 29 or, where applicable, the unmodified IgV sequence containing residues 33-131 of SEQ ID NO: 2.

(SEQ ID NO: 29)
APLKIQAYFNETADLPCQFANSQNQSLSELVVFWQDQENLVLNEVYLGKE

KFDSVHSKYMGRTSFDSDSWTLRLHNLQIKDKGLYQCIIHHKKPTGMIRI

HQMNSELSVLANFSQPEIVPISNITENVYINLTCSSIHGYPEPKKMSVLL

RTKNSTIEYDGVMQKSQDNVTELYDVSISLSVSFPDVTSNMTIFCILETD

KTRLLSSPFSIELEDPQPPPDHIP

Modifications provided herein can be in a wild-type or unmodified CD86 polypeptide set forth in SEQ ID NO: 29 or in a portion thereof contain an IgV domain or a specific binding fragment thereof. In some embodiments, the wild-type or unmodified CD86 polypeptide contains the IgV of CD86 as set forth in SEQ ID NO: 1100. In some embodiments, the wild-type or unmodified CD86 polypeptide contains the IgV of CD86 as set forth in SEQ ID NO: 1104. In some embodiments, the unmodified CD86 polypeptide contains an IgV that can be several amino acids longer or shorter, such as 1-10, e.g. 1, 2, 3, 4, 5, 6 or 7 amino acids longer or shorter, than the sequence of amino acids set forth by SEQ ID NO: 1104. In some embodiments, the unmodified CD86 polypeptide has 85%, 85%, 87%, 88%, 89%, 90%, 91%, 92%, 93%, 94%, 95%, 96%, 97%, 98%, 99% sequence identity to SEQ ID NO: 29, 1100, or 1104. In some embodiments, the unmodified CD86 polypeptide has the sequence set forth in any of SEQ ID NO: 29. In some embodiments, the unmodified CD86 polypeptide has the sequence set forth by SEQ ID NO: 1100. In some embodiments, the unmodified CD86 polypeptide has the sequence set forth by SEQ ID NO: 1104.

(SEQ ID NO: 1104)
NETADLPCQFANSQNQSLSELVVFWQDQENLVLNEVYLGKEKFDSVHSKY

MGRTSFDSDSWTLRLHNLQIKDKGLYQCIIHHKKPTGMIRIHQMNSELS (SEQ ID NO: 1100)
APLKIQAYFNETADLPCQFANSQNQSLSELVVFWQDQENLVLNEVYLGKE

KFDSVHSKYMGRTSFDSDSWTLRLHNLQIKDKGLYQCIIHHKKPTGMIRI

HQMNSELSVLA

It is within the level of a skilled artisan to identify the corresponding position of a modification, e.g. amino acid substitution, in an CD86 polypeptide, including portion thereof containing an IgSF domain (e.g. IgV) thereof, such as by alignment of a reference sequence with SEQ ID NO: 29. An exemplary alignment of SEQ ID NO: 29 containing residues 24-247 of wildtype CD86 with SEQ ID NO: 1104 containing residues 33-131 of wildtype CD86 is shown in FIG. 8. In the listing of modifications throughout this disclosure, the amino acid position is indicated in the middle, with the corresponding unmodified (e.g. wild-type) amino acid listed before the number and the identified variant amino acid substitution listed after the number. If the modification is a deletion of the position a "del" is indicated and if the modification is an insertion at the position an "ins" is indicated.

In some embodiments, the variant CD86 polypeptide has one or more amino acid modification, e.g. substitution in a wild-type or unmodified CD86 sequence. The one or more amino acid modification, e.g. substitution can be in the ectodomain (extracellular domain; ECD) of the wild-type or unmodified CD86 sequence. In some embodiments, the one or more amino acid modification, e.g. substitution is in the IgV domain or specific binding fragment thereof. In some embodiments, the one or more amino acid modification, e.g. substitution is in the IgC domain or specific binding fragment thereof. In some embodiments of the variant CD86 polypeptide, some of the one or more amino acid modification, e.g. substitution, is in the IgV domain or a specific binding fragment thereof, and some of the one or more amino acid modification, e.g. substitution, are in the IgC domain or a specific binding fragment thereof.

In some embodiments, the variant CD86 polypeptide has up to 1, 2, 3, 4, 5, 6, 7, 8, 9, 10, 11, 12, 13, 14, 15, 16, 17, 18, 19, or 20 amino acid modification(s), e.g. substitution. The modification, e.g. substitution can be in the IgV domain or the IgC domain. In some embodiments, the variant CD86 polypeptide has up to 1, 2, 3, 4, 5, 6, 7, 8, 9, 10, 11, 12, 13, 14, 15, 16, 17, 18, 19, or 20 amino acid substitutions in the IgV domain or specific binding fragment thereof. In some embodiments, the variant CD86 polypeptide has up to 1, 2, 3, 4, 5, 6, 7, 8, 9, 10, 11, 12, 13, 14, 15, 16, 17, 18, 19, or 20 amino acid substitutions in the IgC domain or specific binding fragment thereof. In some embodiments, the variant CD86 polypeptide has up to 1, 2, 3, 4, 5, 6, 7, 8, 9, 10, 11, 12, 13, 14, 15, 16, 17, 18, 19, or 20 amino acid modifications, e.g. substitutions, in the ECD or specific binding fragment thereof. In some embodiments, the variant CD86 polypeptide has at least about 85%, 86%, 86%, 88%, 89%, 90%, 91%, 92%, 93%, 94%, 95%, 96%, 97%, 98%, or 99% sequence identity with the wild-type or unmodified CD86 polypeptide or specific binding fragment thereof, such as with the amino acid sequence of SEQ ID NO: 29, 1100, or 1104.

In some embodiments, the variant CD86 polypeptide has one or more amino acid modification, e.g. substitution in an unmodified CD86 or specific binding fragment there of corresponding to position(s) 35, 90, 102 with reference to numbering of SEQ ID NO:29. In some embodiments, the variant CD86 polypeptide has one or more amino acid modifications, e.g. substitutions, in an unmodified CD86 or specific binding fragment thereof corresponding to position(s) 13, 18, 25, 28, 33, 38, 39, 40, 43, 45, 52, 53, 60, 68, 71, 77, 79, 80, 82, 86, 88, 89, 90, 92, 93, 97, 102, 104, 113, 114, 123, 128, 129, 132, 133, 137, 141, 143, 144, 148, 153, 154, 158, 170, 172, 175, 178, 180, 181, 183, 185, 192, 193, 196, 197, 198, 205, 206, 207, 212, 215, 216, 222, 223, or 224, with reference to positions set forth in SEQ ID NO:29. In some embodiments, the modification at position 224 is a deletion. In some embodiments, such variant CD86 polypeptides exhibit altered binding affinity to CD28 compared to the wild-type or unmodified CD86 polypeptide. For example, in some embodiments, the variant CD86 polypeptide exhibits increased binding affinity to CD28 compared to a wild-type or unmodified CD86 polypeptide.

In some embodiments, such variant CD86 polypeptides exhibit altered binding affinity to one or more of CD28 and/or CTLA-4 compared to the wild-type or unmodified CD86 polypeptide. For example, in some embodiments, the variant CD86 polypeptide exhibits increased binding affinity to CD28 compared to a wild-type or unmodified CD86 polypeptide. In some embodiments, the variant CD86 polypeptide exhibits decreased binding affinity to CTLA-4 compared to a wild-type or unmodified CD86 polypeptide. In some embodiments, the variant CD86 polypeptide does not exhibit any change in binding affinity to CTLA-4 compared to a wild-type or unmodified CD86 polypeptide. In some embodiments, the variant CD86 polypeptide does not exhibit an increase in binding affinity to CTLA-4 compared to a wild-type or unmodified CD86 polypeptide. In some embodiments, the variant CD86 polypeptide has one or more amino acid substitutions selected from A13V, Q18K, Q25L, S28G, F33I, E38V, N39D, L40M, L40S, N43K, V45I, F52L, D53G, M60K, D68N, T71A, L77P, I79N, K80E, K80M, K80R, K82T, Q86K, Q86R, I88F, I88T, I89V, H90L, H90Y, K92I, K93T, M97L, Q102H, N104S, F113S, S114G, N123D, V128A, Y129N, L132M, T133A, I137T, P141A, P143H, K144E, V148D, K153E, K153R, N154D, E158G, V170D, E172G, D175E, I178T, L180S, S181P, S183P, P185S, T192N, I193V, I196V, L197M, E198D, L205S, S206I, S207P, E212V, D215V, P216H, H222T or I223F, or a conservative amino acid substitution thereof. In some embodiments, the variant CD86 polypeptide has one or more amino acid modification, e.g. substitution selected from Q35H, H90L, Q102H or a conservative amino acid modification, e.g. substitution thereof. A conservative amino acid modification, e.g. substitution is any amino acid that falls in the same class of amino acids as the substituted amino acids, other than the wild-type or unmodified amino acid. The classes of amino acids are aliphatic (glycine, alanine, valine, leucine, and isoleucine), hydroxyl or sulfur-containing (serine, cysteine, threonine, and methionine), cyclic (proline), aromatic (phenylalanine, tyrosine, tryptophan), basic (histidine, lysine, and arginine), and acidic/amide (aspartate, glutamate, asparagine, and glutamine).

In some embodiments, the variant CD86 polypeptide has two or more amino acid substitutions selected from A13V, Q18K, Q25L, S28G, F33I, E38V, N39D, L40M, L40S, N43K, V45I, F52L, D53G, M60K, D68N, T71A, L77P, I79N, K80E, K80M, K80R, K82T, Q86K, Q86R, I88F, I88T, I89V, H90L, H90Y, K92I, K93T, M97L, Q102H, N104S, F113S, S114G, N123D, V128A, Y129N, L132M, T133A, I137T, P141A, P143H, K144E, V148D, K153E, K153R, N154D, E158G, V170D, E172G, D175E, I178T, L180S, S181P, S183P, P185S, T192N, I193V, I196V, L197M, E198D, L205S, S206I, S207P, E212V, D215V, P216H, H222T or I223F, or a conservative amino acid substitution thereof.

In some embodiments, the variant CD86 polypeptide contains one or more modifications (e.g. amino acid substitutions) at a position corresponding to position(s) selected from 13, 18, 25, 28, 33, 38, 39, 40, 43, 45, 52, 53, 60, 68, 71, 77, 79, 80, 82, 86, 88, 89, 90, 92, 93, 97, 102, 104, 113, 114, 123, 128, 129, 132, 133, 137, 141, 143, 144, 148, 153, 154, 158, 170, 172, 175, 178, 180, 181, 183, 185, 192, 193, 196, 197, 198, 205, 206, 207, 212, 215, 216, 222, 223, or 224 with reference to positions set forth in SEQ ID NO:29. In some embodiments, the amino acid modification is one or more amino acid substitution selected from A13V, Q18K, Q25L, S28G, F33I, E38V, N39D, L40M, L40S, N43K, V45I, F52L, D53G, M60K, D68N, T71A, L77P, I79N, K80E, K80M, K80R, K82T, Q86K, Q86R, I88F, I88T, I89V, H90L, H90Y, K92I, K93T, M97L, Q102H, N104S, F113S, S114G, N123D, V128A, Y129N, L132M, T133A, I137T, P141A, P143H, K144E, V148D, K153E, K153R, N154D, E158G, V170D, E172G, D175E, I178T, L180S, S181P, S183P, P185S, T192N, I193V, I196V, L197M, E198D, L205S, S206T, S207P, E212V, D215V, P216H, H222T or I223F, or a conservative amino acid substitution thereof.

In some embodiments, the variant CD86 polypeptide contains one or more amino acid substitution corresponding to A13V, Q18K, Q25L, S28G, F33I, E38V, N39D, L40M, L40S, N43K, V45I, F52L, D53G, M60K, D68N, T71A, L77P, I79N, K80E, K80M, K80R, K82T, Q86K, Q86R, I88F, I88T, I89V, H90 L, H90Y, K92I, K93T, M97L, Q102H, N104S, F113S, S114G, N123D, V128A, Y129N, L132M, T133A, I137T, P141A, P143H, K144E, V148D, K153E, K153R, N154D, E158G, V170D, E172G, D175E, I178T, L180S, S181P, S183P, P185S, T192N, I193V, I196V, L197M, E198D, L205S, S206I, S207P, E212V, D215V, P216H, H222T or I223F, or a conservative substitution thereof.

In some embodiments, the variant CD86 polypeptide contains at least one modification (e.g. substitution) at a position selected from 25 or 90. In some embodiments, at least one amino acid substitution is Q25L, H90Y, or H90L. In some embodiments, at least one amino acid substitution is Q25L. In some embodiments, at least one amino acid substitution is H90Y or H90L.

In some embodiments, the variant CD86 polypeptide contains amino acid substitutions selected from among Q25L/T71A/H90Y, Q25L/D53G/E212V, Q25L/H90L, N43K/I79N/H90L/I178T/E198D, A13V/Q25L/H90L/S181P/L197M/S206I, Q25L/Q86R/H90L/K93T/L132M/V148D/S181P/P216H, Q25L/F33I/H90Y/V128A/P141A/E158G/S181P, Q25L/N39D/K80R/Q86R/I88F/H90L/K93T/N123D/N154D, Q25L/H90L/K93T/M97L/T133A/S181P/D215V, Q25L/Q86R/H90L/N104S, Q25L/L40M/H90L/L180S/S183P, Q18K/Q25L/F33I/L40S/H90L, Q25L/Q86K/H90L/I137T/S181P, Q25L/L77P/H90Y/K153R/V170D/S181P, Q25L/S28G/F33I/F52L/H90L/Q102H/I178T, Q25L/F33I/H90L/K144E/L180S, Q25L/F33I/H90L/K153E/E172G/T192N, Q25L/F33I/Q86R/H90Y/D175E/I196V/E198D, Q25L/V45I/D68N/H90L/S183P/L205S/, E38V/S114G/P143H, H90Y/L180S, H90Y/Y129N, I89V/H90L/I193V, K80E/H90Y/H222T/I223F/P224L, K80M/I88T, K92I/F113S, M60K/H90L, Q25L/F33I/H90L, Q25L/F33I/Q86R/H90L/K93T, Q25L/H90L, Q25L/H90L/P185S, Q25L/H90L/P185S/P224L, Q25L/H90L/S179R, Q25L/H90Y/S181P/I193V, Q25L/K82T/H90L/T152S/S207P, Q25L/Q86R/H90L/K93T, or S28G/H90Y. In some embodiments, the variant CD86 polypeptide contains amino acid substitutions selected from among Q25L/T71A/H90Y, Q25L/D53G/E212V, Q25L/H90L, N43K/I79N/H90L/I178T/E198D, A13V/Q25L/H90L/S181P/L197M/S206T, Q25L/Q86R/H90L/K93T/L132M/V148D/S181P/P216H, Q25L/F33I/H90Y/V128A/P141A/E158G/S181P, Q25L/N39D/K80R/Q86R/I88F/H90L/K93T/N123D/N154D, Q25L/H90L/K93T/M97L/T133A/S181P/D215V, Q25L/Q86R/H90L/N104S, Q25L/L40M/H90L/L180S/S183P, Q18K/Q25L/F33I/L40S/H90L, Q25L/Q86K/H90L/I137T/S181P, Q25L/L77P/H90Y/K153R/V170D/S181P, Q25L/S28G/F33I/F52L/H90L/Q102H/I178T, Q25L/F33I/H90L/K144E/L180S, Q25L/F33I/H90L/K153E/E172G/T192N, Q25L/F33I/Q86R/H90Y/D175E/I196V/E198D, Q25L/V45I/D68N/H90L/S183P/L205S/, H90Y/L180S, H90Y/Y129N, I89V/H90L/I193V, K80E/H90Y/H222T/I223F/P224L, M60K/H90L; Q25L/F33I/H90L; Q25L/F33I/Q86R/H90L/K93T; Q25L/H90L; Q25L/H90L/P185S; Q25L/H90L/P185S/P224L; Q25L/H90L/S179R; Q25L/H90Y/S181P/I193V; Q25L/K82T/H90L/T152S/S207P; Q25L/Q86R/H90L/K93T, S28G/H90Y, A13V/Q25L/H90L, Q25L/H90L/K93T/M97L, Q25L/Q86R/H90L or I89V/H90L. In some embodiments, the variant CD86 polypeptide contains amino acid substitutions Q25L/H90Y or Q25L/H90L.

In some embodiments, any of the provided variant CD86 polypeptides can further contain one or more amino acid substitutions from A13V, Q18K, Q25L, S28G, F33I, E38V, N39D, L40M, L40S, N43K, V45I, F52L, D53G, M60K, D68N, T71A, L77P, I79N, K80E, K80M, K80R, K82T, Q86K, Q86R, I88F, I88T, I89V, H90 L, H90Y, K92I, K93T, M97L, Q102H, N104S, F113S, S114G, N123D, V128A, Y129N, L132M, T133A, I137T, P141A, P143H, K144E, V148D, K153E, K153R, N154D, E158G, V170D, E172G, D175E, I178T, L180S, S181P, S183P, P185S, T192N, I193V, I196V, L197M, E198D, L205S, S206I, S207P, E212V, D215V, P216H, H222T or I223F.

In some embodiments, among the provided variant CD86 polypeptides are CD86 polypeptides that have amino acid substitutions Q25L/T71A/H90Y, Q25L/D53G/E212V, Q25L/H90L, N43K/I79N/H90L/I178T/E198D, A13V/ Q25L/H90L/S181P/L197M/S206T, Q25L/Q86R/H90L/ K93T/L132M/V148D/S181P/P216H, Q25L/F33I/H90Y/ V128A/P141A/E158G/S181P, Q25L/N39D/K80R/Q86R/ I88F/H90L/K93T/N123D/N154D, Q25L/H90L/K93T/ M97L/T133A/S181P/D215V, Q25L/Q86R/H90L/N104S, Q25L/L40M/H90L/L180S/S183P, Q18K/Q25L/F33I/L40S/ H90L, Q25L/Q86K/H90L/I137T/S181P, Q25L/L77P/ H90Y/K153R/V170D/S181P, Q25L/S28G/F33I/F52L/ H90L/Q102H/I178T, Q25L/F33I/H90L/K144E/L180S, Q25L/F33I/H90L/K153E/E172G/T192N, Q25L/F33I/ Q86R/H90Y/D175E/I196V/E198D, Q25L/V45I/D68N/ H90L/S183P/L205S, E38V/S114G/P143H, H90Y/L180S, H90Y/Y129N, I89V/H90L/I193V, K80E/H90Y/H222T/ I223F/P224L, K80M/I88T, K92I/F113S, M60K/H90L, Q25L/F33I/H90L, Q25L/F33I/Q86R/H90L/K93T, Q25L/ H90L, Q25L/H90L/P185S, Q25L/H90L/P185S/P224L, Q25L/H90L/S179R, Q25L/H90Y/S181P/I193V, Q25L/ K82T/H90L/T152S/S207P, Q25L/Q86R/H90L/K93T, or S28G/H90Y. In some embodiments, among the provided variant CD86 polypeptides are CD86 polypeptides that have amino acid substitutions Q25L/T71A/H90Y, Q25L/D53G/ E212V, Q25L/H90L, N43K/I79N/H90L/I178T/E198D, A13V/Q25L/H90L/S181P/L197M/S206T, Q25L/Q86R/ H90L/K93T/L132M/V148D/S181P/P216H, Q25L/F33I/ H90Y/V128A/P141A/E158G/S181P, Q25L/N39D/K80R/ Q86R/I88F/H90L/K93T/N123D/N154D, Q25L/H90L/ K93T/M97L/T133A/S181P/D215V, Q25L/Q86R/H90L/ N104S, Q25L/L40M/H90L/L180S/S183P, Q18K/Q25L/ F33I/L40S/H90L, Q25L/Q86K/H90L/I137T/S181P, Q25L/ L77P/H90Y/K153R/V170D/S181P, Q25L/S28G/F33I/ F52L/H90L/Q102H/I178T, Q25L/F33I/H90L/K144E/ L180S, Q25L/F33I/H90L/K153E/E172G/T192N, Q25L/ F33I/Q86R/H90Y/D175E/I196V/E198D, Q25L/V45I/ D68N/H90L/S183P/L205S/, H90Y/L180S, H90Y/Y129N, I89V/H90L/I193V, K80E/H90Y/H222T/I223F/P224L, M60K/H90L; Q25L/F33I/H90L; Q25L/F33I/Q86R/H90L/ K93T; Q25L/H90L; Q25L/H90L/P185S; Q25L/H90L/ P185S/P224L; Q25L/H90L/S179R; Q25L/H90Y/S181P/ I193V; Q25L/K82T/H90L/T152S/S207P; Q25L/Q86R/ H90L/K93T, S28G/H90Y, A13V/Q25L/H90L, Q25L/H90L/ K93T/M97L, Q25L/Q86R/H90L or I89V/H90L.

In some embodiments, the one or more amino acid modification, e.g. substitution is Q35H/H90L/Q102H with reference to positions in the CD86 extracellular domain corresponding to positions set forth in SEQ ID NO: 29.

Provided herein are immunomodulatory proteins containing a variant CD86 polypeptide as described herein and a variant PD-1 polypeptide described herein. In some embodiments, the variant CD86 polypeptide is or contains the extracellular domain of CD86 or an IgSF (e.g. IgV) domain thereof or a specific binding fragment thereof containing one or more modifications (e.g. substitutions), such as any as described herein. In some embodiments, the variant PD-1 polypeptide is or contains the extracellular domain of PD-1 or an IgSF (e.g. IgV) domain thereof or a specific binding fragment thereof containing one or more modifications (e.g. substitutions), such as any as described herein. In some embodiments, the CD86/PD-1 immunomodulatory protein exhibits at least 85%, 86%, 87%, 88%, 89%, 90%, 91%, 92%, 93%, 94%, 95%, 96%, 97%, 98% or 99% sequence identity to a sequence set forth in any of SEQ ID NOS:1089, 1090, 1091, 1092, 1093, 1094, 1095, or 1096. In some embodiments, the variant CD86/PD-1 immunomodulatory protein has the sequence set forth in SEQ ID NOS: 1089, 1090, 1091, 1092, 1093, 1094, 1095, or 1096.

In some embodiments, there is provided an immunomodulatory protein containing any of the provided variant PD-1 polypeptides and a variant CD86 polypeptide containing an ECD or a portion thereof containing the IgV and/or IgC domains that contains the one or more amino acid modifications. In some embodiments, the variant PD-1 of the immunomodulatory protein is or contains the sequence set forth by SEQ ID NO: 430. In some embodiments, the variant CD86 of the immunomodulatory protein is or contains the sequence set forth by SEQ ID NO: 1097. In some embodiments, the variant CD86 of the immunomodulatory protein is or contains the sequence set forth by SEQ ID NO: 1098. In some embodiments, the variant CD86 of the immunomodulatory protein is or contains the sequence set forth by SEQ ID NO: 1099. In some embodiments, the variant CD86 of the immunomodulatory protein is or contains the sequence set forth by SEQ ID NO:1101. In some embodiments, the variant CD86 of the immunomodulatory protein is or contains the sequence set forth by SEQ ID NO: 1102. In some embodiments, the variant CD86 of the immunomodulatory protein is or contains the sequence set forth by SEQ ID NO: 1103.

In some embodiments, the immunomodulatory protein is or contains the sequence set forth by SEQ ID NO: 1089. In some embodiments, the immunomodulatory protein is or contains the sequence set forth by SEQ ID NO: 1090. In some embodiments, the immunomodulatory protein is or contains the sequence set forth by SEQ ID NO: 1091. In some embodiments, the immunomodulatory protein is or contains the sequence set forth by SEQ ID NO: 1092. In some embodiments, the immunomodulatory protein is or contains the sequence set forth by SEQ ID NO: 1093. In some embodiments, the immunomodulatory protein is or contains the sequence set forth by SEQ ID NO: 1094. In some embodiments, the immunomodulatory protein is or contains the sequence set forth by SEQ ID NO: 1095. In some embodiments, the immunomodulatory protein is or contains the sequence set forth by SEQ ID NO: 1096.

D. Conjugates and Fusions of Variant Polypeptides and Immunomodulatory Proteins

In some embodiments, the variant polypeptides provided herein, which are immunomodulatory proteins comprising variants of an Ig domain of the IgSF family (vIgD), can be conjugated with or fused with a moiety, such as an effector moiety, such as another protein, directly or indirectly, to form a conjugate ("IgSF conjugate"). In some embodiments, the attachment can be covalent or non-covalent, e.g., via a biotin-streptavidin non-covalent interaction. In some embodiments, the moiety can be a targeting moiety, a small molecule drug (non-polypeptide drug of less than 500 daltons molar mass), a toxin, a cytostatic agent, a cytotoxic agent, an immunosuppressive agent, a radioactive agent suitable for diagnostic purposes, a radioactive metal ion for therapeutic purposes, a prodrug-activating enzyme, an agent that increases biological half-life, or a diagnostic or detectable agent.

In some embodiments the effector moiety is a therapeutic agent, such as a cancer therapeutic agent, which is either cytotoxic, cytostatic or otherwise provides some therapeutic benefit. In some embodiments, the effector moiety is a targeting moiety or agent, such as an agent that targets a cell surface antigen, e.g., an antigen on the surface of a tumor cell. In some embodiments, the effector moiety is a label, which can generate a detectable signal, either directly or indirectly. In some embodiments, the effector moiety is a toxin. In some embodiments, the effector moiety is a protein, peptide, nucleic acid, small molecule or nanoparticle.

In some embodiments, I, 2, 3, 4, 5 or more effector moieties, which can be the same or different, are conjugated, linked or fused to the variant polypeptide or protein to form an IgSF conjugate. In some embodiments, such effector moieties can be attached to the variant polypeptide or immunomodulatory protein using various molecular biological or chemical conjugation and linkage methods known in the art and described below. In some embodiments, linkers such as peptide linkers, cleavable linkers, non-cleavable linkers or linkers that aid in the conjugation reaction, can be used to link or conjugate the effector moieties to the variant polypeptide or immunomodulatory protein.

In some embodiments, the IgSF conjugate comprises the following components: (protein or polypeptide), $(L)_q$ and (effector moiety)$_m$, wherein the protein or polypeptide is any of the described variant polypeptides or immunomodulatory proteins capable of binding one or more cognate counter structure ligands as described; L is a linker for linking the protein or polypeptide to the moiety; m is at least 1; q is 0 or more; and the resulting IgSF conjugate binds to the one or more counter structure ligands. In particular embodiments, m is 1 to 4 and q is 0 to 8.

In some embodiments, there is provided an IgSF conjugate comprising a variant polypeptide or immunomodulatory protein provided herein conjugated with a targeting agent that binds to a cell surface molecule, for example, for targeted delivery of the variant polypeptide or immunomodulatory protein to a specific cell. In some embodiments, the targeting agent is a molecule(s) that has the ability to localize and bind to a molecule present on a normal cell/tissue and/or tumor cell/tumor in a subject. In other words, IgSF conjugates comprising a targeting agent can bind to a ligand (directly or indirectly), which is present on a cell, such as a tumor cell. The targeting agents of the invention contemplated for use include antibodies, polypeptides, peptides, aptamers, other ligands, or any combination thereof, that can bind a component of a target cell or molecule.

In some embodiments, the targeting agent binds a tumor cell(s) or can bind in the vicinity of a tumor cell(s) (e.g., tumor vasculature or tumor microenvironment) following administration to the subject. The targeting agent may bind to a receptor or ligand on the surface of the cancer cell. In another aspect of the invention, a targeting agent is selected which is specific for a noncancerous cells or tissue. For example, a targeting agent can be specific for a molecule present normally on a particular cell or tissue. Furthermore, in some embodiments, the same molecule can be present on normal and cancer cells. Various cellular components and molecules are known. For example, if a targeting agent is specific for EGFR, the resulting IgSF conjugate can target cancer cells expressing EGFR as well as normal skin epidermal cells expressing EGFR. Therefore, in some embodiments, an IgSF conjugate of the invention can operate by two separate mechanisms (targeting cancer and non-cancer cells).

In various aspects of the invention disclosed herein an IgSF conjugate of the invention comprises a targeting agent which can bind/target a cellular component, such as a tumor antigen, a bacterial antigen, a viral antigen, a mycoplasm antigen, a fungal antigen, a prion antigen, an antigen from a parasite. In some aspects, a cellular component, antigen or molecule can each be used to mean, a desired target for a targeting agent. For example, in various embodiments, a targeting agent is specific for or binds to a component, which includes but is not limited to, epidermal growth factor receptor (EGFR, ErbB-1, HERO, ErbB-2 (HER2/neu), ErbB-3/HER3, ErbB-4/HER4, EGFR ligand family; insulin-like growth factor receptor (IGFR) family, IGF-binding proteins (IGFBPs), IGFR ligand family; platelet derived growth factor receptor (PDGFR) family, PDGFR ligand family; fibroblast growth factor receptor (FGFR) family, FGFR ligand family, vascular endothelial growth factor receptor (VEGFR) family, VEGF family; HGF receptor family; TRK receptor family; ephrin (EPH) receptor family; AXL receptor family; leukocyte tyrosine kinase (LTK) receptor family; TIE receptor family, angiopoietin 1,2; receptor tyrosine kinase-like orphan receptor (ROR) receptor family, e.g., ROR1; CD171 (L1CAM); B7-H6 (NCR3LG1); PD-L1, tumor glycosylation antigen, e.g., sTn or Tn, such as sTn Ag of MUC1; LHR (LHCGR); phosphatidylserine, discoidin domain receptor (DDR) family; RET receptor family; KLG receptor family; RYK receptor family; MuSK receptor family; Transforming growth factor-α (TGF-α) receptors, TGF-β; Cytokine receptors, Class I (hematopoietin family) and Class II (interferon/IL-10 family) receptors, tumor necrosis factor (TNF) receptor superfamily (TNFRSF), death receptor family; cancer-testis (CT) antigens, lineage-specific antigens, differentiation antigens, alpha-actinin-4, ARTC1, breakpoint cluster region-Abelson (Bcr-abl) fusion products, B-RAF, caspase-5 (CASP-5), caspase-8 (CASP-8), β-catenin (CTNNB1), cell division cycle 27 (CDC27), cyclin-dependent kinase 4 (CDK4), CDKN2A, COA-I, dek-can fusion protein, EFTUD-2, Elongation factor 2 (ELF2), Ets variant gene 6/acute myeloid leukemia 1 gene ETS (ETC6-AML1) fusion protein, fibronectin (FN), e.g. the extradomain A (EDA) of fibronectin, GPNMB, low density lipid receptor/GDP-L fucose: β-D-galactose 2-α-L-fucosyltransferase (LDLR/FUT) fusion protein, HLA-A2*from an arginine to isoleucine exchange at residue 170 of the α-helix of the α2-domain in the HLA-A2gene product (HLA-A*201-R170I), HLA-A11, heat shock protein 70-2 mutated (HSP70-2M), K1AA0205, MART2, melanoma ubiquitous mutated 1, 2, 3 (MUM-I, 2, 3), prostatic acid phosphatase (PAP), neo-PAP, Myosin class I, NFYC, OGT, OS-9, pml-RARα fusion protein, PRDX5, PTPRK, K-ras (KRAS2), N-ras (NRAS), HRAS, RBAF600, SIRT2, SNRPD1, SYT-SSX1 or -SSX2 fusion protein, Triosephosphate Isomerase, BAGE, BAGK-1, BAGE-2,3,4,5, GAGE-1,2,3,4,5,6,7,8, GnT-V (aberrant N-acetyl glucosaminyl transferase V, MGAT5), HERV-K-MEL, KK-LC, KM-LAGE, LAGE-I, CTL-recognized antigen on melanoma (CAMEL), MAGE-A1 (MAGE-I), MAGE-A2, MAGE-A3, MAGE-A4, MAGE-A5, MAGE-A6, MAGE-A8, MAGE-A9, MAGE-A1O, MAGE-AI1, MAGE-A12, MAGE-3, MAGE-B1, MAGE-B2, MAGE-B5, MAGE-B6, MAGE-C1, MAGE-C2, mucin 1 (MUC1), MART-1/Melan-A (MLANA), gp100, gp100/Pmel17 (SILV), tyrosinase (TYR), TRP-I, HAGE, NA-88, NY-ESO-I, NY-ESO-1/LAGE-2, SAGE, Sp17, SSX-1,2,3,4, TRP2-INT2, carcino-embryonic antigen (CEA), Kallikrein 4, mammaglobin-A, OA1, prostate specific antigen (PSA), TRP-1/gp75, TRP-2, adipophilin, interferon inducible protein absent in melanoma 2 (AIM-2), BING-4, CPSF, cyclin D1, epithelial cell adhesion molecule (Ep-CAM), EphA3, fibroblast growth factor-5 (FGF-5), glycoprotein 250 (gp250), EGFR (ERBB1), HER-2/neu (ERBB2), interleukin 13 receptor α2 chain (IL13Rα2), IL-6 receptor, intestinal carboxyl esterase (iCE), alpha-feto protein (AFP), M-CSF, mdm-2, MUC1, p53 (TP53), PBF, PRAME, PSMA, RAGE-I, RNF43, RU2AS, SOX1O, STEAP1, survivin (BIRC5), human telomerase reverse transcriptase (hTERT), telomerase, Wilms' tumor gene (WT1), SYCP1, BRDT, SPANX, XAGE, ADAM2, PAGE-5, LIP1, CTAGE-I, CSAGE, MMA1, CAGE, BORIS, HOM-TES-85, AF15q14, HCA661, LDHC, MORC, SGY-I, SPO11, TPX1, NY-SAR-35, FTHL17, NXF2, TDRD1, TEX15, FATE, TPTE, immunoglobulin idiotypes, Bence-Jones protein, estrogen receptors (ER), androgen receptors (AR), CD40, CD30, CD20, CD19, CD33, cancer antigen 72-4 (CA 72-4), cancer antigen 15-3 (CA 15-3), cancer antigen 27-29 (CA 27-29), cancer antigen 125 (CA 125), cancer antigen 19-9 (CA 19-9), β-human chorionic gonadotropin, β-2 microglobulin, squamous cell carcinoma antigen, neuron-specific enolase, heat shock protein gp96, GM2, sargramostim, CTLA-4, 707 alanine proline (707-AP), adenocarcinoma antigen recognized by T cells 4 (ART-4), carcinoembryogenic antigen peptide-1 (CAP-I), calcium-activated chloride channel-2 (CLCA2), cyclophilin B (Cyp-B), human signet ring tumor-2 (HST-2), human papillomavirus (HPV) proteins (HPV-E6, HPV-E7, major or minor capsid antigens, others), Epstein-Barr virus (EBV) proteins (EBV latent membrane proteins—LMP1, LMP2; others), hepatitis B or C virus proteins, and HIV proteins.

In some embodiments, an IgSF conjugate, through its targeting agent, will bind a cellular component of a tumor cell, tumor vasculature or tumor microenvironment, thereby promoting killing of targeted cells via modulation of the immune response, (e.g., by activation of co-stimulatory molecules or inhibition of negative regulatory molecules of immune cell activation), inhibition of survival signals (e.g., growth factor or cytokine or hormone receptor antagonists), activation of death signals, and/or immune-mediated cytotoxicity, such as through antibody dependent cellular cytotoxicity. Such IgSF conjugates can function through several mechanisms to prevent, reduce or eliminate tumor cells, such as to facilitate delivery of conjugated effector moieties to the tumor target, such as through receptor-mediated endocytosis of the IgSF conjugate; or such conjugates can recruit, bind, and/or activate immune cells (e.g., NK cells, monocytes/macrophages, dendritic cells, T cells, B cells). Moreover, in some instances one or more of the foregoing pathways may operate upon administration of one or more IgSF conjugates of the invention.

In some embodiments, an IgSF conjugate, through its targeting agent, will be localized to, such as bind to, a cellular component of a tumor cell, tumor vasculature or tumor microenvironment, thereby modulating cells of the immune response in the vicinity of the tumor. In some embodiments, the targeting agent facilitates delivery of the conjugated IgSF (e.g., vIgD) to the tumor target, such as to interact with its cognate binding partner to alter signaling of immune cells (e.g., NK cells, monocytes/macrophages, dendritic cells, T cells, B cells) bearing the cognate binding partner. In some embodiments, localized delivery mediates a blocking activity of the PD-1/PD-L1 inhibitory complex.

In some embodiments, the targeting agent is an immunoglobulin. As used herein, the term "immunoglobulin" includes natural or artificial mono- or polyvalent antibodies including, but not limited to, polyclonal, monoclonal, multispecific, human, humanized or chimeric antibodies, single chain antibodies, Fab fragments, F(ab') fragments, fragments produced by a Fab expression library, single chain Fv (scFv); anti-idiotypic (anti-Id) antibodies (including, e.g., anti-Id antibodies to antibodies of the invention), and epitope-binding fragments of any of the above. The term "antibody," as used herein, refers to immunoglobulin molecules and immunologically active portions of immunoglobulin molecules, e.g., molecules that contain an antigen binding site that immunospecifically binds an antigen. The immunoglobulin molecules of the invention can be of any type (e.g., IgG, IgE, IgM, IgD, IgA, and IgY), class (e.g., IgG1, IgG2, IgG3, IgG4, IgA1, and IgA2) or subclass of immunoglobulin molecule.

In some embodiments, an IgSF conjugate, through its antibody targeting moiety, will bind a cellular component of a tumor cell, tumor vasculature or tumor microenvironment, thereby promoting apoptosis of targeted cells via modulation of the immune response, (e.g., by activation of co-stimulatory molecules or inhibition of negative regulatory molecules of immune cell activation), inhibition of survival signals (e.g., growth factor or cytokine or hormone receptor antagonists), activation of death signals, and/or immune-mediated cytotoxicity, such as through antibody dependent cellular cytotoxicity. Such IgSF conjugates can function through several mechanisms to prevent, reduce or eliminate tumor cells, such as to facilitate delivery of conjugated effector moieties to the tumor target, such as through receptor-mediated endocytosis of the IgSF conjugate; or such conjugates can recruit, bind, and/or activate immune cells (e.g., NK cells, monocytes/macrophages, dendritic cells, T cells, B cells).

In some embodiments, an IgSF conjugate, through its antibody targeting moiety, will bind a cellular component of a tumor cell, tumor vasculature or tumor microenvironment, thereby modulating the immune response (e.g., by activation of co-stimulatory molecules or inhibition of negative regulatory molecules of immune cell activation). In some embodiments, such conjugates can recognize, bind, and/or modulate (e.g. inhibit or activate) immune cells (e.g., NK cells, monocytes/macrophages, dendritic cells, T cells, B cells).

Antibody targeting moieties of the invention include antibody fragments that include, but are not limited to, Fab, Fab' and F(ab')2, Fd, single-chain Fvs (scFv), single-chain antibodies, disulfide-linked Fvs (sdFv) and fragments comprising either a VL or VH domain. Antigen-binding antibody fragments, including single-chain antibodies, may comprise the variable region(s) alone or in combination with the entirety or a portion of the following: hinge region, CH1, CH2, and CH3 domains. Also included in the invention are antigen-binding fragments also comprising any combination of variable region(s) with a hinge region, CH1, CH2, and CH3 domains. Also included in the invention are Fc fragments, antigen-Fc fusion proteins, and Fc-targeting moiety conjugates or fusion products (Fc-peptide, Fc-aptamer). The antibody targeting moieties of the invention may be from any animal origin including birds and mammals. In one aspect, the antibody targeting moieties are human, murine (e.g., mouse and rat), donkey, sheep, rabbit, goat, guinea pig, camel, horse, or chicken. Further, such antibodies may be humanized versions of animal antibodies. The antibody targeting moieties of the invention may be monospecific, bispecific, trispecific, or of greater multispecificity.

In various embodiments, an antibody/targeting moiety recruits, binds, and/or activates immune cells (e.g., NK cells, monocytes/macrophages, dendritic cells) via interactions between Fc (in antibodies) and Fc receptors (on immune cells) and via the conjugated variant polypeptides or immunomodulatory proteins provided herein. In some embodiments, an antibody/targeting moiety recognizes or binds a tumor agent via and localizes to the tumor cell the conjugated variant polypeptides or immunomodulatory proteins provided herein to facilitate modulation of immune cells in the vicinity of the tumor.

Examples of antibodies which can be incorporated into IgSF conjugates include but are not limited to antibodies such as Cetuximab (IMC-C225; Erbitux®), Trastuzumab (Herceptin®), Rituximab (Rituxan®; MabThera®), Bevacizumab (Avastin®), Alemtuzumab (Campath®; Campath-1H®; Mabcampath®), Pertuzumab (Perjeta®), Panitumumab (ABX-EGF; Vectibix®), Ranibizumab (Lucentis®), Ibritumomab, Ibritumomab tiuxetan, (Zevalin®), Tositumomab, Iodine I 131 Tositumomab (BEXXAR®), Catumaxomab (Removab®), Dinutuximab (Unituxin™), Gemtuzumab, Gemtuzumab ozogamicine (Mylotarg®), Abatacept (CTLA4-Ig; Orencia®), Belatacept (L104EA29YIg; LEA29Y; LEA), Ipilimumab (MDX-010; MDX-101), Tremelimumab (ticilimumab; CP-675,206), PRS-010, PRS-050, Aflibercept (VEGF Trap, AVE005), Volociximab (M200), F200, MORAb-009, SS1P (CAT-5001), Cixutumumab (IMC-A12), Matuzumab (EMD72000), Nimotuzumab (h-R3), Zalutumumab (HuMax-EGFR), Necitumumab IMC-11F8, mAb806/ch806, Sym004, mAb-425, Panorex @ (17-1A) (murine monoclonal antibody); Panorex @ (17-1A) (chimeric murine monoclonal antibody); IDEC-Y2B8 (murine, anti-CD2O MAb); BEC2 (anti-idiotypic MAb, mimics the GD epitope) (with BCG); Olaratumab (Lartruvo™), Oncolym (Lym-1 monoclonal antibody); SMART MI95 Ab, humanized 13' I LYM-I (Oncolym), Ovarex (B43.13, anti-idiotypic mouse MAb); Ramucirumab (Cyramza®); MDX-210 (humanized anti-HER-2 bispecific antibody); 3622W94 MAb that binds to EGP40 (17-1A) pancarcinoma antigen on adenocarcinomas; Anti-VEGF, Zenapax (SMART Anti-Tac (IL-2 receptor); SMART MI95 Ab, humanized Ab, humanized); MDX-210 (humanized anti-HER-2 bispecific antibody); MDX-447 (humanized anti-EGF receptor bispecific antibody); NovoMAb-G2 (pancarcinoma specific Ab); TNT (chimeric MAb to histone antigens); TNT (chimeric MAb to histone antigens); Gliomab-H (Monoclons—Humanized Abs); GNI-250 Mab; EMD-72000 (chimeric-EGF antagonist); LymphoCide (humanized LL2 antibody); and MDX-260 bispecific, targets GD-2, ANA Ab, SMART IDIO Ab, SMART ABL 364 Ab or ImmuRAIT-CEA. As illustrated by the forgoing list, it is conventional to make antibodies to a particular target epitope.

In some embodiments, the antibody targeting moiety is a full length antibody, or antigen-binding fragment thereof, containing an Fc domain. In some embodiments, the variant polypeptide or immunomodulatory protein is conjugated to the Fc portion of the antibody targeting moiety, such as by conjugation to the N-terminus of the Fc portion of the antibody.

In some embodiments, the vIgD is linked, directly or indirectly, to the N- or C-terminus of the light and/or heavy chain of the antibody. In some embodiments, linkage can be via a peptide linker, such as any described above. In some embodiments, the antibody conjugate can be produced by co-expression of the heavy and light chain of the antibody in a cell.

In one aspect of the invention, the targeting agent is an aptamer molecule. For example, in some embodiments, the aptamer is comprised of nucleic acids that function as a targeting agent. In various embodiments, an IgSF conjugate of the invention comprises an aptamer that is specific for a molecule on a tumor cell, tumor vasculature, and/or a tumor microenvironment. In some embodiments, the aptamer itself can comprise a biologically active sequence, in addition to the targeting module (sequence), wherein the biologically active sequence can induce an immune response to the target cell. In other words, such an aptamer molecule is a dual use agent. In some embodiments, an IgSF conjugate of the invention comprises conjugation of an aptamer to an antibody, wherein the aptamer and the antibody are specific for binding to separate molecules on a tumor cell, tumor vasculature, tumor microenvironment, and/or immune cells.

The term "aptamer" includes DNA, RNA or peptides that are selected based on specific binding properties to a particular molecule. For example, an aptamer(s) can be selected for binding a particular gene or gene product in a tumor cell, tumor vasculature, tumor microenvironment, and/or an immune cell, as disclosed herein, where selection is made by methods known in the art and familiar to one of skill in the art.

In some aspects of the invention the targeting agent is a peptide. For example, the variant polypeptides or immunomodulatory proteins provided herein can be conjugated to a peptide which can bind with a component of a cancer or tumor cells. Therefore, such IgSF conjugates of the invention comprise peptide targeting agents which binds to a cellular component of a tumor cell, tumor vasculature, and/or a component of a tumor microenvironment. In some embodiments, targeting agent peptides can be an antagonist or agonist of an integrin. Integrins, which comprise an alpha and a beta subunit, include numerous types well known to a skilled artisan.

In one embodiment, the targeting agent is $\alpha v \beta 3$. Integrin $\alpha v \beta 3$ is expressed on a variety of cells and has been shown to mediate several biologically relevant processes, including adhesion of osteoclasts to bone matrix, migration of vascular smooth muscle cells, and angiogenesis. Suitable targeting molecules for integrins include RGD peptides or peptidomimetics as well as non-RGD peptides or peptidomimetics (see, e.g., U.S. Pat. Nos. 5,767,071 and 5,780,426) for other integrins such as $\alpha 4$-$\beta 1$ (VLA-4), $\alpha 4$-$\beta 7$ (see, e.g., U.S. Pat. No. 6,365,619; Chang et al, Bioorganic & Medicinal Chem Lett, 12:159-163 (2002); Lin et al., Bioorganic & Medicinal Chem Lett, I2:133-136 (2002)), and the like.

In some embodiments, there is provided an IgSF conjugate comprising a variant polypeptide or immunomodulatory protein provided herein conjugated with a therapeutic agent. In some embodiments, the therapeutic agent includes, for example, daunomycin, doxorubicin, methotrexate, and vindesine (Rowland et al., Cancer Immunol. Immunother. 21:183-187, 1986). In some embodiments, the therapeutic agent has an intracellular activity. In some embodiments, the IgSF conjugate is internalized and the therapeutic agent is a cytotoxin that blocks the protein synthesis of the cell, therein leading to cell death. In some embodiments, the therapeutic agent is a cytotoxin comprising a polypeptide having ribosome-inactivating activity including, for example, gelonin, bouganin, saporin, ricin, ricin A chain, bryodin, diphtheria toxin, restrictocin, Pseudomonas exotoxin A and variants thereof. In some embodiments, where the therapeutic agent is a cytotoxin comprising a polypeptide having a ribosome-inactivating activity, the IgSF conjugate must be internalized upon binding to the target cell in order for the protein to be cytotoxic to the cells.

In some embodiments, there is provided an IgSF conjugate comprising a variant polypeptide or immunomodulatory protein provided herein conjugated with a toxin. In some embodiments, the toxin includes, for example, bacterial toxins such as diphtheria toxin, plant toxins such as ricin, small molecule toxins such as geldanamycin (Mandler et al., J. Nat. Cancer Inst. 92(19):1573-1581 (2000); Mandler et al., Bioorganic & Med. Chem. Letters 10:1025-1028 (2000); Mandler et al., Bioconjugate Chem. 13:786-791 (2002)), maytansinoids (EP 1391213; Liu et al., Proc. Natl. Acad. Sci. USA 93:8618-8623 (1996)), and calicheamicin (Lode et al., Cancer Res. 58:2928 (1998); Hinman et al., Cancer Res. 53:3336-3342 (1993)). The toxins may exert their cytotoxic and cytostatic effects by mechanisms including tubulin binding, DNA binding, or topoisomerase inhibition.

In some embodiments, there is provided an IgSF conjugate comprising a variant polypeptide or immunomodulatory protein provided herein conjugated with a label, which can generate a detectable signal, indirectly or directly. These IgSF conjugates can be used for research or diagnostic applications, such as for the in vivo detection of cancer. The label is preferably capable of producing, either directly or indirectly, a detectable signal. For example, the label may be radio-opaque or a radioisotope, such as 3H, 14C, 32P, 35S, 123I, 125I, 131I; a fluorescent (fluorophore) or chemiluminescent (chromophore) compound, such as fluorescein isothiocyanate, rhodamine or luciferin; an enzyme, such as alkaline phosphatase, β-galactosidase or horseradish peroxidase; an imaging agent; or a metal ion. In some embodiments, the label is a radioactive atom for scintigraphic studies, for example 99Tc or 123I, or an isotope for nuclear magnetic resonance (NMR) imaging (also known as magnetic resonance imaging, MRI), such as zirconium-89, iodine-123, iodine-131, indium-111, fluorine-19, carbon-13, nitrogen-15, oxygen-17, gadolinium, manganese or iron. Zirconium-89 may be complexed to various metal chelating agents and conjugated to antibodies, e.g., for PET imaging (WO 2011/056983). In some embodiments, the IgSF conjugate is detectable indirectly. For example, a secondary antibody that is specific for the IgSF conjugate and contains a detectable label can be used to detect the IgSF conjugate.

The IgSF conjugates may be prepared using any methods known in the art. See, e.g., WO 2009/067800, WO 2011/133886, and U.S. Patent Application Publication No. 2014322129, incorporated by reference herein in their entirety.

The variant polypeptides or immunomodulatory proteins of an IgSF conjugate may be "attached to" the effector moiety by any means by which the variant polypeptides or immunomodulatory proteins can be associated with, or linked to, the effector moiety. For example, the variant polypeptides or immunomodulatory proteins of an IgSF conjugate may be attached to the effector moiety by chemical or recombinant means. Chemical means for preparing fusions or conjugates are known in the art and can be used to prepare the IgSF conjugate. The method used to conjugate the variant polypeptides or immunomodulatory proteins and effector moiety must be capable of joining the variant polypeptides or immunomodulatory proteins with the effector moiety without interfering with the ability of the variant polypeptides or immunomodulatory proteins to bind to their one or more counter structure ligands.

The variant polypeptides or immunomodulatory proteins of an IgSF conjugate may be linked indirectly to the effector moiety. For example, the variant polypeptides or immunomodulatory proteins of an IgSF conjugate may be directly linked to a liposome containing the effector moiety of one of several types. The effector moiety(s) and/or the variant polypeptides or immunomodulatory proteins may also be bound to a solid surface.

In some embodiments, the variant polypeptides or immunomodulatory proteins of an IgSF conjugate and the effector moiety are both proteins and can be conjugated using techniques well known in the art. There are several hundred crosslinkers available that can conjugate two proteins. (See for example "Chemistry of Protein Conjugation and Crosslinking," 1991, Shans Wong, CRC Press, Ann Arbor). The crosslinker is generally chosen based on the reactive functional groups available or inserted on the variant polypeptides or immunomodulatory proteins and/or effector moiety. In addition, if there are no reactive groups, a photoactivatible crosslinker can be used. In certain instances, it may be desirable to include a spacer between the variant polypeptides or immunomodulatory proteins and the effector moiety. Crosslinking agents known to the art include the homobifunctional agents: glutaraldehyde, dimethyladipimidate and Bis(diazo)benzidine and the heterobifunctional agents: m-Maleimidobenzoyl-N-Hydroxysuccinimide and Sulfo-m Maleimidobenzoyl-N-Hydroxysuccinimide.

In some embodiments, the variant polypeptides or immunomodulatory proteins of an IgSF conjugate may be engineered with specific residues for chemical attachment of the effector moiety. Specific residues used for chemical attachment of molecule known to the art include lysine and cysteine. The crosslinker is chosen based on the reactive functional groups inserted on the variant polypeptides or immunomodulatory proteins, and available on the effector moiety.

An IgSF conjugate may also be prepared using recombinant DNA techniques. In such a case a DNA sequence encoding the variant polypeptides or immunomodulatory proteins is fused to a DNA sequence encoding the effector moiety, resulting in a chimeric DNA molecule. The chimeric DNA sequence is transfected into a host cell that expresses the fusion protein. The fusion protein can be recovered from the cell culture and purified using techniques known in the art.

Examples of attaching an effector moiety, which is a label, to the variant polypeptides or immunomodulatory proteins include the methods described in Hunter, et al., Nature 144:945 (1962); David, et al., Biochemistry 13:1014 (1974); Pain, et al., J. Immunol. Meth. 40:219 (1981); Nygren, J. Histochem. and Cytochem. 30:407 (1982); Wensel and Meares, Radioimmunoimaging And Radioimmunotherapy, Elsevier, N.Y. (1983); and Colcher et al., "Use Of Monoclonal Antibodies As Radiopharmaceuticals For The Localization Of Human Carcinoma Xenografts In Athymic Mice", Meth. Enzymol., I21:802-16 (1986).

The radio- or other labels may be incorporated in the conjugate in known ways. For example, the peptide may be biosynthesized or may be synthesized by chemical amino acid synthesis using suitable amino acid precursors involving, for example, fluorine-19 in place of hydrogen. Labels such as 99Tc or 123I, 186Re, I88Re and 111In can be attached via a cysteine residue in the peptide. Yttrium-90 can be attached via a lysine residue. The IODOGEN method (Fraker et al., Biochem. Biophys. Res. Commun. 80:49-57 (1978)) can be used to incorporate iodine-123. "Monoclonal Antibodies in Immunoscintigraphy" (Chatal, CRC Press 1989) describes other methods in detail.

Conjugates of the variant polypeptides or immunomodulatory proteins and a cytotoxic agent may be made using a variety of bifunctional protein coupling agents such as N-succinimidyl-3-(2-pyridyldithio) propionate (SPDP), succinimidyl-4-(N-maleimidomethyl) cyclohexane-1-carboxylate (SMCC), iminothiolane (IT), bifunctional derivatives of imidoesters (such as dimethyl adipimidate HCl), active esters (such as disuccinimidyl suberate), aldehydes (such as glutaraldehyde), bis-azido compounds (such as bis (p-azidobenzoyl) hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene). For example, a ricin immunotoxin can be prepared as described in Vitetta et al., Science 238:1098 (1987). Carbon-14-labeled 1-p-isothiocyanatobenzyl-3-methyldiethylenetriaminepentaacetic acid (MX-DTPA) is an exemplary chelating agent for conjugation of radionucleotide to the antibody. See, e.g., WO94/11026. The linker may be a "cleavable linker" facilitating release of the cytotoxic drug in the cell. For example, an acid-labile linker, peptidase-sensitive linker, photolabile linker, dimethyl linker or disulfide-containing linker (Chari et al., Cancer Research 52:127-131 (1992); U.S. Pat. No. 5,208,020) may be used.

The IgSF conjugates of the invention expressly contemplate, but are not limited to, drug conjugates prepared with cross-linker reagents: BMPS, EMCS, GMBS, HBVS, LC-SMCC, MBS, MPBH, SBAP, SIA, SIAB, SMCC, SMPB, SMPH, sulfo-EMCS, sulfo-GMBS, sulfo-KMUS, sulfo-MBS, sulfo-SIAB, sulfo-SMCC, and sulfo-SMPB, and SVSB (succinimidyl-(4-vinylsulfone)benzoate) which are commercially available (e.g., from Pierce Biotechnology, Inc., Rockford, IL, U.S.A). See pages 467-498, 2003-200 μL Applications Handbook and Catalog.

E. Transmembrane and Secretable Immunomodulatory Proteins and Engineered Cells

Provided herein are engineered cells which express the immunomodulatory variant PD-1 polypeptides (alternatively, "engineered cells"). In some embodiments, the expressed immunomodulatory variant PD-1 polypeptide is a transmembrane protein and is surface expressed. In some embodiments, the expressed immunomodulatory variant PD-1 polypeptide is expressed and secreted from the cell.

1. Transmembrane Immunomodulatory Proteins

In some embodiments, an immunomodulatory polypeptide comprising a variant PD-1 can be a membrane bound protein. As described in more detail below, the immunomodulatory polypeptide can be a transmembrane immunomodulatory polypeptide comprising a variant PD-1 in which is contained: an ectodomain containing at least one affinity modified IgSF domain (IgV), a transmembrane domain and, optionally, a cytoplasmic domain. In some embodiments, the transmembrane immunomodulatory protein can be expressed on the surface of an immune cell, such as a mammalian cell, including on the surface of a lymphocyte (e.g., T cell or NK cell) or antigen presenting cell. In some embodiments, the transmembrane immunomodulatory protein is expressed on the surface of a mammalian T-cell, including such T-cells as: a T helper cell, a cytotoxic T-cell (alternatively, cytotoxic T lymphocyte or CTL), a natural killer T-cell, a regulatory T-cell, a memory T-cell, or a gamma delta T-cell. In some embodiments, the mammalian cell is an antigen presenting cell (APC). Typically, but not exclusively, the ectodomain (alternatively, "extracellular domain") of comprises the one or more amino acid variations (e.g., amino acid substitutions) of the variant PD-1 of the invention. Thus, for example, in some embodiments a transmembrane protein will comprise an ectodomain that comprises one or more amino acid substitutions of a variant PD-1 of the invention.

In some embodiments, the engineered cells express a variant PD-1 polypeptides are transmembrane immunomodulatory polypeptides (TIPs) that can be a membrane protein such as a transmembrane protein. In typical embodiments, the ectodomain of a membrane protein comprises an extracellular domain or IgSF domain thereof of a variant PD-1 provided herein in which is contained one or more amino acid substitutions in at least one IgSF domain as described. The transmembrane immunomodulatory proteins provided herein further contain a transmembrane domain linked to the ectodomain. In some embodiments, the transmembrane domain results in an encoded protein for cell surface expression on a cell. In some embodiments, the transmembrane domain is linked directly to the ectodomain. In some embodiments, the transmembrane domain is linked indirectly to the ectodomain via one or more linkers or spacers. In some embodiments, the transmembrane domain contains predominantly hydrophobic amino acid residues, such as leucine and valine.

In some embodiments, a full length transmembrane anchor domain can be used to ensure that the TIPs will be expressed on the surface of the engineered cell, such as engineered T cell. Conveniently, this could be from a particular native protein that is being affinity modified (e.g. PD-1 or other native IgSF protein), and simply fused to the sequence of the first membrane proximal domain in a similar fashion as the native IgSF protein (e.g. PD-1). In some embodiments, the transmembrane immunomodulatory protein comprises a transmembrane domain of the corresponding wild-type or unmodified IgSF member, such as a transmembrane domain contained in the sequence of amino acids set forth in SEQ ID NO:10 (Table 2). In some embodiments, the membrane bound form comprises a transmembrane domain of the corresponding wild-type or unmodified polypeptide, such as corresponding to residues 171-191 of SEQ ID NO:10.

In some embodiments, the transmembrane domain is a non-native transmembrane domain that is not the transmembrane domain of native PD-1. In some embodiments, the transmembrane domain is derived from a transmembrane domain from another non-PD-1 family member polypeptide that is a membrane-bound or is a transmembrane protein. In some embodiments, a transmembrane anchor domain from another protein on T cells can be used. In some embodiments, the transmembrane domain is derived from CD8. In some embodiments, the transmembrane domain can further contain an extracellular portion of CD8 that serves as a spacer domain. An exemplary CD8 derived transmembrane domain is set forth in SEQ ID NO: 465 or 612 or a portion thereof containing the CD8 transmembrane domain. In some embodiments, the transmembrane domain is a synthetic transmembrane domain.

In some embodiments, the transmembrane immunomodulatory protein lacks an endodomain or cytoplasmic signaling domain capable of mediating an intracellular signal in a cell. In some embodiments, the transmembrane immunomodulatory protein lacks the signal transduction mechanism of the wild-type or unmodified polypeptide and therefore does not itself induce cell signaling. In some embodiments, the transmembrane immunomodulatory protein does not contain an ITIM (immunoreceptor tyrosine-based inhibition motif), such as contained in certain inhibitory receptors, including PD-1. In some embodiments, the transmembrane immunomodulatory protein lacks an intracellular (cytoplasmic) domain or a portion of the intracellular domain of the corresponding wild-type or unmodified polypeptide, such as a cytoplasmic signaling domain contained in the sequence of amino acids set forth in SEQ ID NO:10 (see Table 2). Thus, in some embodiments, the transmembrane immunomodulatory protein only contains the ectodomain (e.g. IgV) and the transmembrane domain, such as any as described. In some embodiments, a transmembrane immunomodulatory protein (TIP) provided herein, such as a TIP that does not contain a cytoplasmic signaling domain, e.g. ITIM, can be used as a decoy counter-structure to inhibit specific binding by and between PD-1 and one or more of its native counter-structures.

In some embodiments, a transmembrane immunomodulatory protein that lacks an intracellular domain can include one or more cytoplasmic amino acids that do not confer intracellular signaling activity. In some aspects, a transmembrane immunomodulatory protein provided herein can contain a cytoplasmic trailer sequence of at least one amino acid, such as ten amino acids, that are C-terminal to the transmembrane domain. In some cases, the C-terminal cytoplasmic trailer sequence is hydrophobic. In some cases, the C-terminal cytoplasmic trailer sequence is charged. In an exemplary embodiment, the C-terminal cytoplasmic trailer sequence is the amino acid sequence "RSKS".

In some embodiments, the transmembrane immunomodulatory protein further contains an endodomain, such as a cytoplasmic signaling domain, linked to the transmembrane domain. In some embodiments, the cytoplasmic signaling domain induces cell signaling. In some embodiments, the endodomain of the transmembrane immunomodulatory protein comprises the cytoplasmic domain of the corresponding wild-type or unmodified polypeptide, such as a cytoplasmic domain contained in the sequence of amino acids set forth in SEQ ID NO:10 (see Table 2).

In some embodiments, a provided transmembrane immunomodulatory protein that is or comprises a variant PD-1 comprises a sequence of amino acids that exhibits at least 85%, 86%, 87%, 88%, 89%, 90%, 91%, 92%, 93%, 94%, 95%, 96%, 97%, 98% or 99% sequence identity to SEQ ID NO: 64 and contains an ectodomain comprising at least one affinity-modified PD-1 IgSF domain as described and a transmembrane domain. In some embodiments, the transmembrane immunomodulatory protein contains any one or more amino acid substitutions in an IgSF domain (e.g., IgV domain) as described, including any set forth in Table 1. In some embodiments, the transmembrane immunomodulatory protein can further comprise a cytoplasmic domain as described. In some embodiments, the transmembrane immunomodulatory protein can further contain a signal peptide. In some embodiments, the signal peptide is the native signal peptide of wild-type IgSF member, such as contained in the sequence of amino acids set forth in SEQ ID NO:10 (see e.g., Table 2).

Also provided is a nucleic acid molecule encoding such transmembrane immunomodulatory proteins. In some embodiments, a nucleic acid molecule encoding a transmembrane immunomodulatory protein comprises a nucleotide sequence that encodes a sequence of amino acids that exhibits at least 85%, 86%, 87%, 88%, 89%, 90%, 91%, 92%, 93%, 94%, 95%, 96%, 97%, 98% or 99% sequence identity to SEQ ID NOS: 64 and contains an ectodomain comprising at least one affinity-modified IgSF domain as described, a transmembrane domain and, optionally, a cytoplasmic domain. In some embodiments, the nucleic acid molecule can further comprise a sequence of nucleotides encoding a signal peptide. In some embodiments, the signal peptide is the native signal peptide of the corresponding wild-type IgSF member (see e.g., Table 2).

In some embodiments, provided are transmembrane immunomodulatory proteins that are switch receptors (switch-TIPs) in which the inhibitory signaling domain of PD-1 is replaced or substituted with one or more activating and/or costimulatory signaling domain. Among embodiments provided herein are engineered cells, such as immune cells, e.g. T cells, expressing a switch TIP to modulate, such as increase, an immune response. In some embodiments, the immune response is increased by the activity of the switch receptor to provide one or more activating and/or costimulatory signal upon binding of a cognate ligand, e.g. PD-L1. In some cases, binding of a variant PD-1 switch TIP with its cognate ligand, e.g. PD-L1, can further block inhibitory signaling through native PD-1 expressed by the immune cell.

In some embodiments, a PD-1 switch receptor contains an extracellular domain containing a variant PD-1 containing at least one affinity-modified IgSF domain, a transmembrane domain and an intracellular signaling domain containing one or more activating and/or costimulatory signaling domain. In some embodiments, a PD-1 switch receptor contains at least one activating intracellular domain containing at least one ITAM (immunoreceptor tyrosine-based activation motif)-containing signaling domain. In some aspects, an activating intracellular signaling domain is or contains a signaling region of a primary T cell signaling molecule, such as a signaling domain of CD3zeta. In some embodiments, a PD-1 switch receptor contains at least one costimulatory signaling domain containing a signaling region of a costimulatory receptor, such as a costimulatory receptor that potentiates or increases a primary signal delivered to a T cells. In some embodiments, the costimulatory receptor is selected from CD28, 41BB, OX40, ICOS or GITR. In some embodiments, the intracellular signaling domain of a switch receptor contains one, two or three costimulatory signaling regions of a costimulatory receptor.

In some embodiments, provided are switch receptors in which the endodomain of a transmembrane immunomodulatory protein comprises a cytoplasmic signaling domain that comprises at least one ITAM (immunoreceptor tyrosine-based activation motif)-containing signaling domain. ITAM is a conserved motif found in a number of protein signaling domains involved in signal transduction of immune cells, including in the CD3-zeta chain ("CD3-z") involved in T-cell receptor signal transduction. In some embodiments, the endodomain comprises a CD3-zeta signaling domain. In some embodiments, the CD3-zeta signaling domain comprises the sequence of amino acids set forth in SEQ ID NO: 607 or a sequence of amino acids that exhibits at least 85%, 86%, 87%, 88%, 89%, 90%, 91%, 92%, 93%, 94%, 95%, 96%, 97%, 98% or 99% to SEQ ID NO:607 and retains the activity of T cell signaling. In some embodiments, the endodomain of a switch receptor can further comprise a costimulatory signaling domain to further modulate immunomodulatory responses of the T-cell. In some embodiments, the costimulatory signaling domain is CD28, ICOS, 41BB or OX40. In some embodiments, the costimulatory signaling domain is a derived from CD28 or 4-1BB and comprises the sequence of amino acids set forth in any of SEQ ID NOs: 613-616 or 990 or a sequence of amino acids that exhibits at least 85%, 86%, 87%, 88%, 89%, 90%, 91%, 92%, 93%, 94%, 95%, 96%, 97%, 98% or 99% to SEQ ID NOs:613-616 or 990 and retains the activity of T cell costimulatory signaling. In some embodiments, the provided switch receptors have features of activating receptors to stimulate T cell signaling upon binding of an affinity modified IgSF domain to a cognate binding partner or counter structure. In some embodiments, upon specific binding by the affinity-modified IgSF domain to its counter structure can lead to changes in the immunological activity of the T-cell activity as reflected by changes in cytotoxicity, proliferation or cytokine production. In some embodiments, the switch receptor is expressed in an immune cell, such as a T cell, for use as an engineered cellular therapy. In some aspects, the switch receptor is co-expressed with a recombinant or engineered TCR or a CAR). In some examples, the switch receptor is expressed by a TCR engineered T cell.

In some embodiments, the switch receptor comprises one costimulatory domain. In some embodiments, the switch receptor comprises one costimulatory domain selected from a intracellular signaling domain from CD28, 41BB, or ICOS. In some embodiments, the switch receptor comprises one costimulatory domain selected from a domain derived from CD28, 41BB, or ICOS comprising the sequence of amino acids set forth in one of SEQ ID NOs: 613-616, 990, or 992 or a sequence of amino acids that exhibits at least 85%, 86%, 87%, 88%, 89%, 90%, 91%, 92%, 93%, 94%, 95%, 96%, 97%, 98% or 99% sequence identity to SEQ ID NOs: 613-616, 990, or 992 and retains T cell costimulatory signaling activity.

In some embodiments, the switch receptor comprises more than one costimulatory domain. In some embodiments, the switch receptor comprises more than one costimulatory domain comprising at least two domains selected from domains derived from CD28, 41BB, or ICOS, such as domains derived from CD28 and 41BB, CD28 and ICOS, 41BB and ICOS, or all three of CD28, 41BB, and ICOS. In some embodiments, the switch receptor comprises more than one costimulatory domain comprising at least two domains selected from CD28, 41BB, or ICOS wherein at least two of the at least two domains each comprise the sequence of amino acids set forth in one of SEQ ID NOs: 613-616, 990 or 992 or a sequence of amino acids that exhibits at least 85%, 86%, 87%, 88%, 89%, 90%, 91%, 92%, 93%, 94%, 95%, 96%, 97%, 98% or 99% sequence identity to SEQ ID NOs: 613-616, 990 or 992 and retains the activity of T cell costimulatory signaling.

In some embodiments, the switch receptor comprises a transmembrane domain derived from CD28, 41BB, or ICOS. In some embodiments, the transmembrane domain is derived from CD28, 41BB, or ICOS and comprises the sequence of amino acids set forth in any of SEQ ID NOs: 988, 989, or 991 or a sequence of amino acids that exhibits at least 85%, 86%, 87%, 88%, 89%, 90%, 91%, 92%, 93%, 94%, 95%, 96%, 97%, 98% or 99% sequence identity to SEQ ID NOs: 988, 989, or 991 and retains the activity of T cell costimulatory signaling.

In some embodiments, the switch receptor comprises a hinge region. In some embodiments, the hinge region is derived from CD8. The CD8 hinge region comprises a cysteine at position 181 which, in some cases, is predicted to be a free unpaired cysteine prone to formation of disulfide bonds with other free cysteines. C181 is also known to mediate binding to CD8beta chain. In some embodiments, the CD8 hinge region comprises a mutation at position C181 to reduce its potential to pair with free cysteines. In some embodiments, the CD8 hinge region comprises a mutation at position C181 to reduce or abrogate binding to CD8beta chain. In some embodiments the CD8 hinge region comprises the mutation C181S. In some embodiments, the hinge region is derived from CD8 and comprises the sequence of amino acids set forth in SEQ ID NO: 986 or SEQ ID NO: 987 or a sequence of amino acids that exhibits at least 85%, 86%, 87%, 88%, 89%, 90%, 91%, 92%, 93%, 94%, 95%, 96%, 97%, 98% or 99% sequence identity to SEQ ID NO: 986 or SEQ ID NO: 987 and retains the activity of T cell costimulatory signaling.

In some embodiments, the switch receptor comprises the sequence of amino acids set forth in any of SEQ ID NOs: 993-1036 or SEQ ID NOs: 1081-1084 or a sequence of amino acids that exhibits at least 85%, 86%, 87%, 88%, 89%, 90%, 91%, 92%, 93%, 94%, 95%, 96%, 97%, 98% or 99% sequence identity to SEQ ID NOs: 993-1036 or SEQ ID NOs: 1081-1084 and retains the activity of T cell costimulatory signaling. In some embodiments, provided is a nucleic acid sequence encoding the switch receptor comprising the nucleotide sequence set forth in any of SEQ ID NOs: 1037-1080 or SEQ ID NOs: 1085-1088 or a nucleotide sequence that exhibits at least 85%, 86%, 87%, 88%, 89%, 90%, 91%, 92%, 93%, 94%, 95%, 96%, 97%, 98% or 99% sequence identity to SEQ ID NOs: 1037-1080 or SEQ ID NOs: 1085-1088, wherein the encoded switch receptor retains the activity of T cell costimulatory signaling.

Also provided herein is a lentiviral vector for delivery of a nucleic acid sequence encoding a switch receptor. Also provided herein is a lentiviral vector for delivery of a T cell receptor, such as a lentiviral vector encoding a T cell receptor alpha and a T cell receptor beta. In some embodiments, the lentiviral vector is polycistronic. In some embodiments, the polycistronic lentiviral vector delivers a nucleic acid sequence encoding a switch receptor and nucleic acid sequences encoding a T cell receptor, such as a nucleic acid sequence encoding a T cell receptor beta chain sequence and a T cell receptor alpha chain sequence. In some embodiments, the polycistronic lentiviral vector comprises an immunoglobulin secretion leader, such as an IgH secretion leader, for targeting of the switch receptor to the cell membrane. In some embodiments, the polycistronic lentiviral vector comprises a furin cleavage site. In some embodiments, the polycistronic lentiviral vector comprises a self-cleaving peptide, such as a self-cleaving 2A peptide (T2A). In some embodiments, the polycistronic lentiviral vector comprises a nucleic acid sequence encoding a T cell receptor beta sequence and a T cell receptor alpha sequence, wherein the T cell receptor beta and T cell receptor alpha sequences are separated by cleavage sites, such as a furin cleavage site and a self-cleaving peptide, such as a P2A self-cleaving peptide (P2A). In some embodiments, the lentiviral vector encoding a switch receptor or the polycistronic lentiviral encoding a switch receptor and a T cell receptor is codon optimized and/or splice optimized. In an exemplary embodiment, the polycistronic lentiviral vector encodes in the N-terminal to C-terminal direction an IgH secretion leader, a switch receptor, a SGSG spacer, a furin cleavage site, a SSGSGGSG spacer, a T2A self-cleaving peptide, a T cell receptor beta, a furin cleavage site, a SSGSGGSG spacer, a P2A self-cleaving peptide, and a T cell receptor alpha.

In one aspect, a method of engineering a cell, such as an immune cell, to express a switch receptor is provided. In some embodiments, the method comprises engineering the cell to express the switch receptor. In some embodiments, the method comprises engineering the cell to express a switch receptor and a T cell receptor. In some embodiments, the T cell is engineered to express the switch receptor and the T cell receptor by transduction by at least two lentiviral vectors. In some embodiments, the T cell is engineered to express the switch receptor and the T cell receptor by transduction by a polycistronic lentivirus vector, such as a lentivirus vector encoding a switch receptor and a T cell receptor. In some embodiments, the engineered cell expresses a switch receptor comprising the amino acid sequence set forth in any of SEQ ID NOs: 993-1036 or 1081-1084 or an amino acid sequence that exhibits at least 85%, 86%, 87%, 88%, 89%, 90%, 91%, 92%, 93%, 94%, 95%, 96%, 97%, 98% or 99% sequence identity to SEQ ID NOs: 993-1036 or 1081-1084, wherein the switch receptor retains the activity of T cell costimulatory signaling.

2. Secreted Immunomodulatory Proteins and Engineered Cells

In some embodiments, the PD-1 variant immunomodulatory polypeptide containing any one or more of the amino acid mutations as described herein, is secretable, such as when expressed from a cell. Such a variant PD-1 immunomodulatory protein does not comprise a transmembrane domain. In some embodiments, the variant PD-1 immunomodulatory protein is not conjugated to a half-life extending moiety (such as an Fc domain or a multimerization domain). In some embodiments, the variant PD-1 immunomodulatory protein comprises a signal peptide, e.g., an antibody signal peptide or other efficient signal sequence to get domains outside of cell. When the immunomodulatory protein comprises a signal peptide and is expressed by an engineered cell, the signal peptide causes the immunomodulatory protein to be secreted by the engineered cell. Generally, the signal peptide, or a portion of the signal peptide, is cleaved from the immunomodulatory protein with secretion. The immunomodulatory protein can be encoded by a nucleic acid (which can be part of an expression vector). In some embodiments, the immunomodulatory protein is expressed and secreted by a cell (such as an immune cell, for example a primary immune cell).

Thus, in some embodiments, there are provided variant PD-1 immunomodulatory proteins that further comprises a signal peptide. In some embodiments, provided herein is a nucleic acid molecule encoding the variant PD-1 immunomodulatory protein operably connected to a secretion sequence encoding the signal peptide.

A signal peptide is a sequence on the N-terminus of an immunomodulatory protein that signals secretion of the immunomodulatory protein from a cell. In some embodiments, the signal peptide is about 5 to about 40 amino acids in length (such as about 5 to about 7, about 7 to about 10, about 10 to about 15, about 15 to about 20, about 20 to about 25, or about 25 to about 30, about 30 to about 35, or about 35 to about 40 amino acids in length).

In some embodiments, the signal peptide is a native signal peptide from the corresponding wild-type PD-1 (see Table 1). In some embodiments, the signal peptide is a non-native signal peptide. For example, in some embodiments, the non-native signal peptide is a mutant native signal peptide from the corresponding wild-type PD-1, and can include one or more (such as 2, 3, 4, 5, 6, 7, 8, 9, or 10 or more) substitutions insertions or deletions. In some embodiments, the non-native signal peptide is a signal peptide or mutant thereof of a family member from the same IgSF family as the wild-type IgSF family member. In some embodiments, the non-native signal peptide is a signal peptide or mutant thereof from an IgSF family member from a different IgSF family that the wild-type IgSF family member. In some embodiments, the signal peptide is a signal peptide or mutant thereof from a non-IgSF protein family, such as a signal peptide from an immunoglobulin (such as IgG heavy chain or IgG-kappa light chain), a cytokine (such as interleukin-2 (IL-2), or CD33), a serum albumin protein (e.g., HSA or albumin), a human azurocidin preprotein signal sequence, a luciferase, a trypsinogen (e.g., chymotrypsinogen or trypsinogen) or other signal peptide able to efficiently secrete a protein from a cell. Exemplary signal peptides include any described in the Table 3.

TABLE 3

Exemplary Signal Peptides

| SEQ ID NO | Signal Peptide | Peptide Sequence |
|---|---|---|
| SEQ ID NO: 85 | HSA signal peptide | MKWVTFISLLFLFSSAYS |
| SEQ ID NO: 86 | Ig kappa light chain | MDMRAPAGIFGFLLVLFPGYRS |
| SEQ ID NO: 87 | human azurocidin preprotein signal sequence | MTRLTVLALLAGLLASSRA |
| SEQ ID NO: 88 | IgG heavy chain signal peptide | MELGLSWIFLLAILKGVQC |
| SEQ ID NO: 89 | IgG heavy chain signal peptide | MELGLRWVFLVAILEGVQC |
| SEQ ID NO: 90 | IgG heavy chain signal peptide | MKHLWFFLLLVAAPRWVLS |
| SEQ ID NO: 91 | IgG heavy chain signal peptide | MDWTWRILFLVAAATGAHS |
| SEQ ID NO: 92 | IgG heavy chain signal peptide | MDWTWRFLFVVAAATGVQS |
| SEQ ID NO: 93 | IgG heavy chain signal peptide | MEFGLSWLFLVAILKGVQC |
| SEQ ID NO: 94 | IgG heavy chain signal peptide | MEFGLSWVFLVALFRGVQC |
| SEQ ID NO: 95 | IgG heavy chain signal peptide | MDLLHKNMKHLWFFLLLVAAPRWVLS |
| SEQ ID NO: 96 | IgG Kappa light chain signal sequences: | MDMRVPAQLLGLLLLWLSGARC |
| SEQ ID NO: 97 | IgG Kappa light chain signal sequences: | MKYLLPTAAAGLLLLAAQPAMA |
| SEQ ID NO: 98 | *Gaussia luciferase* | MGVKVLFALICIAVAEA |
| SEQ ID NO: 99 | Human albumin | MKWVTFISLLFLFSSAYS |
| SEQ ID NO: 100 | Human chymotrypsinogen | MAFLWLLSCWALLGTTFG |

TABLE 3-continued

Exemplary Signal Peptides

| SEQ ID NO | Signal Peptide | Peptide Sequence |
|---|---|---|
| SEQ ID NO: 101 | Human interleukin-2 | MQLLSCIALILALV |
| SEQ ID NO: 102 | Human trypsinogen-2 | MNLLLILTFVAAAVA |

In some embodiments of a secretable variant PD-1 immunomodulatory protein, the immunomodulatory protein comprises a signal peptide when expressed, and the signal peptide (or a portion thereof) is cleaved from the immunomodulatory protein upon secretion.

In some embodiments, the engineered cells express variant PD-1 polypeptides that are secreted from the cell. In some embodiments, such a variant PD-1 polypeptide is encoded by a nucleic acid molecule encoding an immunomodulatory protein under the operable control of a signal sequence for secretion. In some embodiments, the encoded immunomodulatory protein is secreted when expressed from a cell. In some embodiments, the immunomodulatory protein encoded by the nucleic acid molecule does not comprise a transmembrane domain. In some embodiments, the immunomodulatory protein encoded by the nucleic acid molecule does not comprise a half-life extending moiety (such as an Fc domain or a multimerization domain). In some embodiments, the immunomodulatory protein encoded by the nucleic acid molecule comprises a signal peptide. In some embodiments, a nucleic acid of the invention further comprises nucleotide sequence that encodes a secretory or signal peptide operably linked to the nucleic acid encoding the immunomodulatory protein, thereby allowing for secretion of the immunomodulatory protein 3. Cells and Engineering Cells Provided herein are engineered cells expressing any of the provided immunomodulatory polypeptide. In some embodiments, the engineered cells express on their surface any of the provided transmembrane immunomodulatory polypeptides. In some embodiments, the engineered cells express and are capable of or are able to secrete the immunomodulatory protein from the cells under conditions suitable for secretion of the protein. In some embodiments, the immunomodulatory protein is expressed on a lymphocyte such as a tumor infiltrating lymphocyte (TIL), T-cell or NK cell, or on a myeloid cell. In some embodiments, the engineered cells are antigen presenting cells (APCs). In some embodiments, the engineered cells are engineered mammalian T-cells or engineered mammalian antigen presenting cells (APCs). In some embodiments, the engineered T-cells or APCs are human or murine cells.

In some embodiments, engineered T-cells include, but are not limited to, T helper cell, cytotoxic T-cell (alternatively, cytotoxic T lymphocyte or CTL), natural killer T-cell, regulatory T-cell, memory T-cell, or gamma delta T-cell. In some embodiments, the engineered T cells are CD4+ or CD8+.

In some embodiments, the engineered APCs include, for example, MHC II expressing APCs such as macrophages, B cells, and dendritic cells, as well as artificial APCs (aAPCs) including both cellular and acellular (e.g., biodegradable polymeric microparticles) aAPCs. Artificial APCs (aAPCs) are synthetic versions of APCs that can act in a similar manner to APCs in that they present antigens to T-cells as well as activate them. Antigen presentation is performed by the MHC (Class I or Class II). In some embodiments, in engineered APCs such as aAPCs, the antigen that is loaded onto the MHC is, in some embodiments, a tumor specific antigen or a tumor associated antigen. The antigen loaded onto the MHC is recognized by a T-cell receptor (TCR) of a T cell. Materials which can be used to engineer an aAPC include: poly (glycolic acid), poly(lactic-co-glycolic acid), iron-oxide, liposomes, lipid bilayers, sepharose, and polystyrene.

In some embodiments a cellular aAPC can be engineered to contain a TIP and TCR agonist which is used in adoptive cellular therapy. In some embodiments, a cellular aAPC can be engineered to contain a TIP and TCR agonist which is used in ex vivo expansion of human T cells, such as prior to administration, e.g., for reintroduction into the patient. In some aspects, the aAPC may include expression of at least one anti-CD3 antibody clone, e.g., such as, for example, OKT3 and/or UCHT1. In some aspects, the aAPCs may be inactivated (e.g., irradiated). In some embodiment, the TIP can include any variant IgSF domain that exhibits binding affinity for a cognate binding partner on a T cell.

In some embodiments, an immunomodulatory protein provided herein, such as a transmembrane immunomodulatory protein or a secretable immunomodulatory protein, is co-expressed or engineered into a cell that expresses an antigen-binding receptor, such as a recombinant receptor, such as a chimeric antigen receptor (CAR) or T cell receptor (TCR). In some embodiments, the engineered cell, such as an engineered T cell, recognizes a desired antigen associated with cancer, inflammatory and autoimmune disorders, or a viral infection. In specific embodiments, the antigen-binding receptor contains an antigen-binding moiety that specifically binds a tumor specific antigen or a tumor associated antigen. In some embodiments, the engineered T-cell is a CAR (chimeric antigen receptor) T-cell that contains an antigen-binding domain (e.g., scFv) that specifically binds to an antigen, such as a tumor specific antigen or tumor associated antigen. In some embodiments, the TIP protein is expressed in an engineered T-cell receptor cell or and engineered chimeric antigen receptor cell. In such embodiments, the engineered cell co-expresses the TIP and the CAR or TCR. In some embodiments, the SIP protein is expressed in an engineered T-cell receptor cell or an engineered chimeric antigen receptor cell. In such embodiments, the engineered cell co-expresses the SIP and the CAR or TCR.

Chimeric antigen receptors (CARs) are recombinant receptors that include an antigen-binding domain (ectodomain), a transmembrane domain and an intracellular signaling region (endodomain) that is capable of inducing or mediating an activation signal to the T cell after the antigen is bound. In some example, CAR-expressing cells are engineered to express an extracellular single chain variable fragment (scFv) with specificity for a particular tumor antigen linked to an intracellular signaling part comprising an activating domain and, in some cases, a costimulatory domain. The costimulatory domain can be derived from, e.g., CD28, OX-40, 4-1BB/CD137, inducible T cell costimulator (ICOS). The activating domain can be derived from, e.g., CD3, such as CD3 zeta, epsilon, delta, gamma, or the like. In certain embodiments, the CAR is designed to have two, three, four, or more costimulatory domains. The CAR scFv can be designed to target an antigen expressed on a cell associated with a disease or condition, e.g., a tumor antigen, such as, for example, CD19, which is a transmembrane protein expressed by cells in the B cell lineage, including all normal B cells and B cell malignances, including but not limited to NHL, CLL, and non-T cell ALL. Example CAR+ T cell therapies and constructs are described in U.S. Patent Publication Nos. 2013/0287748, 2014/0227237, 2014/0099309, and 2014/0050708, and these references are incorporated by reference in their entirety.

In some aspects, the antigen-binding domain is an antibody or antigen-binding fragment thereof, such as a single chain fragment (scFv). In some embodiments, the antigen is expressed on a tumor or cancer cell. Exemplary of an antigen is CD19. Exemplary of a CAR is an anti-CD19 CAR, such as a CAR containing an anti-CD19 scFv set forth in SEQ ID NO:611 or SEQ ID NO:621. In some embodiments, the CAR further contains a spacer, a transmembrane domain, and an intracellular signaling domain or region comprising an ITAM signaling domain, such as a CD3zeta signaling domain. In some embodiments, the CAR further includes a costimulatory signaling domain.

In some embodiments, the spacer and transmembrane domain are the hinge and transmembrane domain derived from CD8, such as having an exemplary sequence set forth in SEQ ID NO: 465, 612, 625 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 465, 612, or 625. In some embodiments, the endodomain comprises at CD3-zeta signaling domain. In some embodiments, the CD3-zeta signaling domain comprises the sequence of amino acids set forth in SEQ ID NO: 607 or a sequence of amino acids that exhibits at least 85%, 86%, 87%, 88%, 89%, 90%, 91%, 92%, 93%, 94%, 95%, 96%, 97%, 98% or 99% or more sequence identity to SEQ ID NO: 607 and retains the activity of T cell signaling. In some embodiments, the endodomain of a CAR can further comprise a costimulatory signaling region to further modulate immunomodulatory responses of the T-cell. In some embodiments, the costimulatory signaling domain is or comprises a costimulatory region, or is derived from a costimulatory region, of CD28, ICOS, 41BB or OX40. In some embodiments, the costimulatory signaling domain is a derived from CD28 or 4-1BB and comprises the sequence of amino acids set forth in any of SEQ ID NOS: 613-616 or a sequence of amino acids that exhibits at least 85%, 86%, 87%, 88%, 89%, 90%, 91%, 92%, 93%, 94%, 95%, 96%, 97%, 98% or 99% or more sequence identity to SEQ ID NO:613-616 and retains the activity of T cell costimulatory signaling.

In some embodiments, the construct encoding the CAR further encodes a second protein, such as a marker, e.g., detectable protein, separated from the CAR by a self-cleaving peptide sequence. In some embodiments, the self-cleaving peptide sequence is an F2A, T2A, E2A or P2A self-cleaving peptide. Exemplary sequences of a T2A self-cleaving peptide are set for the in any one of SEQ ID NOS: 615, 624 or 626 or a sequence of amino acids that exhibits at least 85%, 86%, 87%, 88%, 89%, 90%, 91%, 92%, 93%, 94%, 95%, 96%, 97%, 98% or 99% or more sequence identity to any of SEQ ID NOS: 615, 624 or 626. In some embodiments, the T2A is encoded by the sequence of nucleotides set forth in SEQ ID NO:623 or a sequence that exhibits at least 85%, 86%, 87%, 88%, 89%, 90%, 91%, 92%, 93%, 94%, 95%, 96%, 97%, 98% or 99% or more sequence identity to any of SEQ ID NO: 623. An exemplary sequence of a P2A self-cleaving peptide is set in SEQ ID NO: 638 or a sequence of amino acids that exhibits at least 85%, 86%, 87%, 88%, 89%, 90%, 91%, 92%, 93%, 94%, 95%, 96%, 97%, 98% or 99% or more sequence identity to SEQ ID NOS: 638. In some cases, a nucleic acid construct that encodes more than one P2A self-cleaving peptide (such as a P2A1 and P2A2), in which the nucleotide sequence P2A1 and P2A2 each encode the P2A set forth in SEQ ID NO:638, the nucleotide sequence may be different to avoid recombination between sequences.

In some embodiments, the marker is a detectable protein, such as a fluorescent protein, e.g. a green fluorescent protein (GFP) or blue fluorescent protein (BFP). Exemplary sequences of a fluorescent protein marker are set forth in SEQ ID NO: 617 627, 628, 641, or 642, or a sequence of amino acids that exhibits at least 85%, 86%, 87%, 88%, 89%, 90%, 91%, 92%, 93%, 94%, 95%, 96%, 97%, 98% or 99% or more sequence identity to SEQ ID NO: 617, 627, 628, 641, or 642.

In some embodiments, the CAR has the sequence of amino acids set forth in any of SEQ ID NOS: 608, 618, 619, 620, 629, 630, 632 or 633 or a sequence of amino acids that exhibits at least 85%, 86%, 87%, 88%, 89%, 90%, 91%, 92%, 93%, 94%, 95%, 96%, 97%, 98% or 99% or more sequence identity to any one of SEQ ID NOS: 608, 618, 619, 620, 629, 630, 632 or 633. In some embodiments, the CAR is encoded by a sequence of nucleotides set forth in SEQ ID NO: 626 or 631 or a sequence of amino acids that exhibits at least 85%, 86%, 87%, 88%, 89%, 90%, 91%, 92%, 93%, 94%, 95%, 96%, 97%, 98% or 99% or more sequence identity to any one of SEQ ID NO: 626 or 631.

In another embodiment, the engineered T-cell possesses a TCR, including a recombinant or engineered TCR. In some embodiments, the TCR can be a native TCR. Those of skill in the art will recognize that generally native mammalian T-cell receptors comprise an alpha and a beta chain (or a gamma and a delta chain) involved in antigen specific recognition and binding. In some embodiments, the TCR is an engineered TCR that is modified. In some embodiments, the TCR of an engineered T-cell specifically binds to a tumor associated or tumor specific antigen presented by an APC.

In some embodiments, the immunomodulatory polypeptides, such as transmembrane immunomodulatory polypeptides or secretable immunomodulatory polypeptides, can be incorporated into engineered cells, such as engineered T cells or engineered APCs, by a variety of strategies such as those employed for recombinant host cells. A variety of methods to introduce a DNA construct into primary T cells are known in the art. In some embodiments, viral transduction or plasmid electroporation are employed. In typical embodiments, the nucleic acid molecule encoding the immunomodulatory protein, or the expression vector, comprises a signal peptide that localizes the expressed transmembrane immunomodulatory proteins to the cellular membrane or for secretion. In some embodiments, a nucleic acid encoding a transmembrane immunomodulatory proteins of the invention is sub-cloned into a viral vector, such as a retroviral vector, which allows expression in the host mammalian cell. The expression vector can be introduced into a mammalian host cell and, under host cell culture conditions, the immunomodulatory protein is expressed on the surface or is secreted.

In an exemplary example, primary T-cells can be purified ex vivo (CD4 cells or CD8 cells or both) and stimulated with an activation protocol consisting of various TCR/CD28 agonists, such as anti-CD3/anti-CD28 coated beads. After a 2 or 3 day activation process, a recombinant expression vector containing an immunomodulatory polypeptide can be stably introduced into the primary T cells through art standard lentiviral or retroviral transduction protocols or plasmid electroporation strategies. Cells can be monitored for immunomodulatory polypeptide expression by, for example, flow cytometry using anti-epitope tag or antibodies that cross-react with native parental molecule and polypeptides comprising variant PD-1. T-cells that express the immunomodulatory polypeptide can be enriched through sorting with anti-epitope tag antibodies or enriched for high or low expression depending on the application.

Upon immunomodulatory polypeptide expression the engineered T-cell can be assayed for appropriate function by a variety of means. The engineered CAR or TCR co-expression can be validated to show that this part of the engineered T cell was not significantly impacted by the expression of the immunomodulatory protein. Once validated, standard in vitro cytotoxicity, proliferation, or cytokine assays (e.g., IFN-gamma expression) can be used to assess the function of engineered T-cells. Exemplary standard endpoints are percent lysis of the tumor line, proliferation of the engineered T-cell, or IFN-gamma protein expression in culture supernatants. An engineered construct which results in statistically significant increased lysis of tumor line, increased proliferation of the engineered T-cell, or increased IFN-gamma expression over the control construct can be selected for. Additionally, non-engineered, such as native primary or endogenous T-cells could also be incorporated into the same in vitro assay to measure the ability of the immunomodulatory polypeptide construct expressed on the engineered cells, such as engineered T-cells, to modulate activity, including, in some cases, to activate and generate effector function in bystander, native T-cells. Increased expression of activation markers such as CD69, CD44, or CD62L could be monitored on endogenous T cells, and increased proliferation and/or cytokine production could indicate desired activity of the immunomodulatory protein expressed on the engineered T cells.

In some embodiments, the similar assays can be used to compare the function of engineered T cells containing the CAR or TCR alone to those containing the CAR or TCR and a TIP construct. Typically, these in vitro assays are performed by plating various ratios of the engineered T cell and a "tumor" cell line containing the cognate CAR or TCR antigen together in culture. Standard endpoints are percent lysis of the tumor line, proliferation of the engineered T cell, or IFN-gamma production in culture supernatants. An engineered immunomodulatory protein which resulted in statistically significant increased lysis of tumor line, increased proliferation of the engineered T cell, or increased IFN-gamma production over the same TCR or CAR construct alone can be selected for. Engineered human T cells can be analyzed in immunocompromised mice, like the NSG strain, which lacks mouse T, NK and B cells. Engineered human T cells in which the CAR or TCR binds a target counter-structure on the xenograft and is co-expressed with the TIP affinity modified IgSF domain can be adoptively transferred in vivo at different cell numbers and ratios compared to the xenograft. For example, engraftment of CD19+ leukemia tumor lines containing a luciferase/GFP vector can be monitored through bioluminescence or ex vivo by flow cytometry. In a common embodiment, the xenograft is introduced into the murine model, followed by the engineered T cells several days later. Engineered T cells containing the immunomodulatory protein can be assayed for increased survival, tumor clearance, or expanded engineered T cells numbers relative to engineered T cells containing the CAR or TCR alone. As in the in vitro assay, endogenous, native (i.e., non-engineered) human T cells could be co-adoptively transferred to look for successful epitope spreading in that population, resulting in better survival or tumor clearance.

F. Infectious Agents Expressing Variant Polypeptides and Immunomodulatory Proteins Also provided are infectious agents that contain nucleic acids encoding any of the variant polypeptides, such as PD-1 vIgD polypeptides, including secretable or transmembrane immunomodulatory proteins described herein. In some embodiments, such infectious agents can deliver the nucleic acids encoding the variant immunomodulatory polypeptides described herein, such as PD-1 vIgD polypeptides, to a target cell in a subject, e.g., immune cell and/or antigen-presenting cell (APC) or tumor cell in a subject. Also provided are nucleic acids contained in such infectious agents, and/or nucleic acids for generation or modification of such infectious agents, such as vectors and/or plasmids, and compositions containing such infectious agents.

In some embodiments, the infectious agent is a microorganism or a microbe. In some embodiments, the infectious agent is a virus or a bacterium. In some embodiments, the infectious agent is a virus. In some embodiments, the infectious agent is a bacterium. In some embodiments, such infectious agents can deliver nucleic acid sequences encoding any of the variant polypeptides, such as PD-1 vIgD polypeptides, including secretable or transmembrane immunomodulatory proteins, described herein. Thus, in some embodiments, the cell in a subject that is infected or contacted by the infectious agents can be rendered to express on the cell surface or secrete, the variant immunomodulatory polypeptides. In some embodiments, the infectious agent can also deliver one or more other therapeutics or nucleic acids encoding other therapeutics to the cell and/or to an environment within the subject. In some embodiments, other therapeutics that can be delivered by the infectious agents include cytokines or other immunomodulatory molecules.

In some embodiments, the infectious agent, e.g., virus or bacteria, contains nucleic acid sequences that encode any of the variant polypeptides, such as PD-1 vIgD polypeptides, including secretable or transmembrane immunomodulatory proteins, described herein, and by virtue of contact and/or infection of a cell in the subject, the cell expresses the variant polypeptides, such as PD-1 vIgD polypeptides, including secretable or transmembrane immunomodulatory proteins, encoded by the nucleic acid sequences contained in the infectious agent. In some embodiments, the infectious agent can be administered to the subject. In some embodiments, the infectious agent can be contacted with cells from the subject ex vivo.

In some embodiments, the variant polypeptides, such as PD-1 vIgD polypeptides, including transmembrane immunomodulatory proteins, expressed by the cell infected by the infectious agent is a transmembrane protein and is surface expressed. In some embodiments, the variant polypeptides, such as PD-1 vIgD polypeptides, including secretable immunomodulatory proteins, expressed by the cell infected by the infectious agent is expressed and secreted from the cell. The transmembrane immunomodulatory protein or secreted immunomodulatory protein can be any described herein.

In some embodiments, the cells in the subject that are targeted by the infectious agent include a tumor cell, an immune cell, and/or an antigen-presenting cell (APC). In some embodiments, the infectious agent targets a cell in the tumor microenvironment (TME). In some embodiments, the infectious agent delivers the nucleic acids encoding the variant polypeptides, such as PD-1 vIgD polypeptides, including secretable or transmembrane immunomodulatory proteins, to an appropriate cell (for example, an APC, such as a cell that displays a peptide/MHC complex on its cell surface, such as a dendritic cell) or tissue (e.g., lymphoid tissue) that will induce and/or augment the desired effect, e.g., immunomodulation and/or a specific cell-medicated immune response, e.g., CD4 and/or CD8 T cell response, which CD8 T cell response may include a cytotoxic T cell (CTL) response. In some embodiments, the infectious agent targets an APC, such as a dendritic cell (DC). In some embodiments, the nucleic acid molecule delivered by the infectious agents described herein include appropriate nucleic acid sequences necessary for the expression of the operably linked coding sequences encoding the variant immunomodulatory polypeptides, in a particular target cell, e.g., regulatory elements such as promoters.

In some embodiments, the infectious agent that contains nucleic acid sequences encoding the immunomodulatory polypeptides can also contain nucleic acid sequences that encode one or more additional gene products, e.g., cytokines, prodrug converting enzymes, cytotoxins and/or detectable gene products. For example, in some embodiments, the infectious agent is an oncolytic virus and the virus can include nucleic acid sequences encoding additional therapeutic gene products (see, e.g., Kim et al., (2009) Nat Rev Cancer 9:64-71; Garcia-Aragoncillo et al., (2010) Curr Opin Mol Ther 12:403-411; see U.S. Pat. Nos. 7,588,767, 7,588,771, 7,662,398 and 7,754,221 and U.S. Pat. Publ. Nos. 2007/0202572, 2007/0212727, 2010/0062016, 2009/0098529, 2009/0053244, 2009/0155287, 2009/0117034, 2010/0233078, 2009/0162288, 2010/0196325, 2009/0136917 and 2011/0064650. In some embodiments, the additional gene product can be a therapeutic gene product that can result in death of the target cell (e.g., tumor cell) or gene products that can augment or boost or regulate an immune response (e.g., cytokine). Exemplary gene products also include among an anticancer agent, an anti-metastatic agent, an antiangiogenic agent, an immunomodulatory molecule, an immune checkpoint inhibitor, an antibody, a cytokine, a growth factor, an antigen, a cytotoxic gene product, a pro-apoptotic gene product, an anti-apoptotic gene product, a cell matrix degradative gene, genes for tissue regeneration or reprogramming human somatic cells to pluripotency, and other genes described herein or known to one of skill in the art. In some embodiments, the additional gene product is Granulocyte-macrophage colony-stimulating factor (GM-CSF).

1. Viruses

In some embodiments, the infectious agent is a virus. In some embodiments, the infectious agent is an oncolytic virus, or a virus that targets particular cells, e.g., immune cells. In some embodiments, the infectious agent targets a tumor cell and/or cancer cell in the subject. In some embodiments, the infectious agent targets an immune cell or an antigen-presenting cell (APC).

In some embodiments, the infectious agent is an oncolytic virus. Oncolytic viruses are viruses that accumulate in tumor cells and replicate in tumor cells. By virtue of replication in the cells, and optional delivery of nucleic acids encoding variant PD-1 polypeptide or immunomodulatory polypeptides described herein, tumor cells are lysed, and the tumor shrinks and can be eliminated. Oncolytic viruses can also have a broad host and cell type range. For example, oncolytic viruses can accumulate in immunoprivileged cells or immunoprivileged tissues, including tumors and/or metastases, and also including wounded tissues and cells, thus allowing the delivery and expression of nucleic acids encoding the variant immunomodulatory polypeptides described herein in a broad range of cell types. Oncolytic viruses can also replicate in a tumor cell specific manner, resulting in tumor cell lysis and efficient tumor regression.

Exemplary oncolytic viruses include adenoviruses, adeno-associated viruses, herpes viruses, Herpes Simplex Virus, Vesticular Stomatic virus, Reovirus, Newcastle Disease virus, parvovirus, measles virus, vesticular stomatitis virus (VSV), Coxsackie virus and Vaccinia virus. In some embodiments, oncolytic viruses can specifically colonize solid tumors, while not infecting other organs, and can be used as an infectious agent to deliver the nucleic acids encoding the variant immunomodulatory polypeptides described herein to such solid tumors.

Oncolytic viruses for use in delivering the nucleic acids encoding variant PD-1 polypeptides or immunomodulatory polypeptides described herein, can be any of those known to one of skill in the art and include, for example, vesicular stomatitis virus, see, e.g., U.S. Pat. Nos. 7,731,974, 7,153,510, 6,653,103 and U.S. Pat. Pub. Nos. 2010/0178684, 2010/0172877, 2010/0113567, 2007/0098743, 20050260601, 20050220818 and EP Pat. Nos. 1385466, 1606411 and 1520175; herpes simplex virus, see, e.g., U.S. Pat. Nos. 7,897,146, 7,731,952, 7,550,296, 7,537,924, 6,723,316, 6,428,968 and U.S. Pat. Pub. Nos., 2014/0154216, 2011/0177032, 2011/0158948, 2010/0092515, 2009/0274728, 2009/0285860, 2009/0215147, 2009/0010889, 2007/0110720, 2006/0039894, 2004/0009604, 2004/0063094, International Patent Pub. Nos., WO 2007/052029, WO 1999/038955; retroviruses, see, e.g., U.S. Pat. Nos. 6,689,871, 6,635,472, 5,851,529, 5,716,826, 5,716,613 and U.S. Pat. Pub. No. 20110212530; vaccinia viruses, see, e.g., 2016/0339066, and adeno-associated viruses, see, e.g., U.S. Pat. Nos. 8,007,780, 7,968,340, 7,943,374, 7,906,111, 7,927,585, 7,811,814, 7,662,627, 7,241,447, 7,238,526, 7,172,893, 7,033,826, 7,001,765, 6,897,045, and 6,632,670.

Oncolytic viruses also include viruses that have been genetically altered to attenuate their virulence, to improve their safety profile, enhance their tumor specificity, and they have also been equipped with additional genes, for example cytotoxins, cytokines, prodrug converting enzymes to improve the overall efficacy of the viruses (see, e.g., Kirn et al., (2009) Nat Rev Cancer 9:64-71; Garcia-Aragoncillo et al., (2010) Curr Opin Mol Ther 12:403-411; see U.S. Pat. Nos. 7,588,767, 7,588,771, 7,662,398 and 7,754,221 and U.S. Pat. Publ. Nos. 2007/0202572, 2007/0212727, 2010/0062016, 2009/0098529, 2009/0053244, 2009/0155287, 2009/0117034, 2010/0233078, 2009/0162288, 2010/0196325, 2009/0136917 and 2011/0064650). In some embodiments, the oncolytic viruses can be those that have been modified so that they selectively replicate in cancerous cells, and, thus, are oncolytic. For example, the oncolytic virus is an adenovirus that has been engineered to have modified tropism for tumor therapy and also as gene therapy vectors. Exemplary of such is ONYX-015, H101 and AdSΔCR (Hallden and Portella (2012) Expert Opin Ther Targets, 16:945-58) and TNFerade (McLoughlin et al. (2005) Ann. Surg. Oncol., 12:825-30), or a conditionally replicative adenovirus Oncorine®.

In some embodiments, the infectious agent is a modified herpes simplex virus. In some embodiments, the infectious agent is a modified version of Talimogene laherparepvec (also known as T-Vec, Imlygic or OncoVex GM-CSF), that is modified to contain nucleic acids encoding any of the variant immunomodulatory polypeptides described herein, such as variant PD-1 polypeptide described herein. In some embodiments, the infectious agent is a modified herpes simplex virus that is described, e.g., in WO 2007/052029, WO 1999/038955, US 2004/0063094, US 2014/0154216, or, variants thereof.

In some embodiments, the infectious agent is a virus that targets a particular type of cells in a subject that is administered the virus, e.g., a virus that targets immune cells or antigen-presenting cells (APCs). Dendritic cells (DCs) are essential APCs for the initiation and control of immune responses. DCs can capture and process antigens, migrate from the periphery to a lymphoid organ, and present the antigens to resting T cells in a major histocompatibility complex (MHC)-restricted fashion. In some embodiments, the infectious agent is a virus that specifically can target DCs to deliver nucleic acids encoding the variant PD-1 polypeptides or immunomodulatory polypeptides for expression in DCs. In some embodiments, the virus is a lentivirus or a variant or derivative thereof, such as an integration-deficient lentiviral vector. In some embodiments, the virus is a lentivirus that is pseudotyped to efficiently bind to and productively infect cells expressing the cell surface marker dendritic cell-specific intercellular adhesion molecule-3-grabbing non-integrin (DC-SIGN), such as DCs. In some embodiments, the virus is a lentivirus pseudotyped with a Sindbis virus E2 glycoprotein or modified form thereof, such as those described in WO 2013/149167. In some embodiments, the virus allows for delivery and expression of a sequence of interest (e.g., a nucleic acid encoding any of the variant PD-1 polypeptides or immunomodulatory polypeptides described herein) to a DC. In some embodiments, the virus includes those described in WO 2008/011636 or US 2011/0064763, Tareen et al. (2014) Mol. Ther., 22:575-587, or variants thereof. Exemplary of a dendritic cell-tropic vector platform is ZVex™

2. Bacteria

In some embodiments, the infectious agent is a bacterium. For example, in some embodiments, the bacteria can deliver nucleic acids encoding any of the variant immunomodulatory polypeptides described herein to a target cell in the subject, such as a tumor cell, an immune cell, an antigen-presenting cell and/or a phagocytic cell. In some embodiments, the bacterium can be preferentially targeted to a specific environment within a subject, such as a tumor microenvironment (TME), for expression and/or secretion of the variant immunomodulatory polypeptides and/or to target specific cells in the environment for expression of the variant immunomodulatory polypeptides.

In some embodiments, the bacterium delivers the nucleic acids to the cells via bacterial-mediated transfer of plasmid DNA to mammalian cells (also referred to as "bactofection"). For example, in some embodiments, delivery of genetic material is achieved through entry of the entire bacterium into target cells. In some embodiments, spontaneous or induced bacterial lysis can lead to the release of plasmid for subsequent eukaryotic cell expression. In some embodiments, the bacterium can deliver nucleic acids to non-phagocytic mammalian cells (e.g., tumor cells) and/or to phagocytic cells, e.g., certain immune cells and/or APCs. In some embodiments, the nucleic acids delivered by the bacterium can be transferred to the nucleus of the cell in the subject for expression. In some embodiments, the nucleic acids also include appropriate nucleic acid sequences necessary for the expression of the operably linked sequences encoding the variant immunomodulatory polypeptides in a particular host cell, e.g., regulatory elements such as promoters or enhancers. In some embodiments, the infectious agent that is a bacterium can deliver nucleic acids encoding the immunomodulatory proteins in the form of an RNA, such as a pre-made translation-competent RNA delivered to the cytoplasm of the target cell for translation by the target cell's machinery.

In some embodiments, the bacterium can replicate and lyse the target cells, e.g., tumor cells. In some embodiments, the bacterium can contain and/or release nucleic acid sequences and/or gene products in the cytoplasm of the target cells, thereby killing the target cell, e.g., tumor cell. In some embodiments, the infectious agent is bacterium that can replicate specifically in a particular environment in the subject, e.g., tumor microenvironment (TME). For example, in some embodiments, the bacterium can replicate specifically in anaerobic or hypoxic microenvironments. In some embodiments, conditions or factors present in particular environments, e.g., aspartate, serine, citrate, ribose or galactose produced by cells in the TME, can act as chemoattractants to attract the bacterium to the environment. In some embodiments, the bacterium can express and/or secrete the immunomodulatory proteins described herein in the environment, e.g., TME.

In some embodiments, the infectious agent is a bacterium that is a *Listeria* sp., a *Bifidobacterium* sp., an *Escherichia* sp., a *Clostridium* sp., a *Salmonella* sp., a *Shigella* sp., a *Vibrio* sp. or a *Yersinia* sp. In some embodiments, the bacterium is selected from among one or more of *Listeria monocytogenes, Salmonella typhimurium, Salmonella choleraesuis, Escherichia coli, Vibrio cholera, Clostridium perfringens, Clostridium butyricum, Clostridium novyi, Clostridium acetobutylicum, Bifidobacterium infantis, Bifidobacterium longum* and *Bifidobacterium adolescentis*. In some embodiments, the bacterium is an engineered bacterium. In some embodiments, the bacterium is an engineered bacterium such as those described in, e.g., Seow and Wood (2009) Molecular Therapy 17(5):767-777; Baban et al. (2010) Bioengineered Bugs 1:6, 385-394; Patyar et al. (2010) J Biomed Sci 17:21; Tangney et al. (2010) Bioengineered Bugs 1:4, 284-287; van Pijkeren et al. (2010) Hum Gene Ther. 21(4):405-416; WO 2012/149364; WO 2014/198002; U.S. Pat. Nos. 9,103,831; 9,453,227; US 2014/0186401; US 2004/0146488; US 2011/0293705; US 2015/0359909 and EP 3020816. The bacterium can be modified to deliver nucleic acid sequences encoding any of the variant immunomodulatory polypeptides, conjugates and/or fusions provided herein, and/or to express such variant immunomodulatory polypeptides in the subject.

G. Nucleic Acids, Vectors and Methods for Producing the Polypeptides or Cells

Provided herein are isolated or recombinant nucleic acids collectively referred to as "nucleic acids" which encode any of the various provided embodiments of the variant PD-1 polypeptides or immunomodulatory polypeptides provided herein. In some embodiments, nucleic acids provided herein, including all described below, are useful in recombinant production (e.g., expression) of variant PD-1 polypeptides or immunomodulatory polypeptides provided herein. In some embodiments, nucleic acids provided herein, including all described below, are useful in expression of variant PD-1 polypeptides or immunomodulatory polypeptides provided herein in cells, such as in engineered cells, e.g., immune cells, or infectious agent cells. The nucleic acids provided herein can be in the form of RNA or in the form of DNA, and include mRNA, cRNA, recombinant or synthetic RNA and DNA, and cDNA. The nucleic acids provided herein are typically DNA molecules, and usually double-stranded DNA molecules. However, single-stranded DNA, single-stranded RNA, double-stranded RNA, and hybrid DNA/RNA nucleic acids or combinations thereof comprising any of the nucleotide sequences of the invention also are provided.

Also provided herein are recombinant expression vectors and recombinant host cells useful in producing the variant PD-1 polypeptides or immunomodulatory polypeptides provided herein.

Also provided herein are engineered cells, such as engineered immune cells, containing any of the provided nucleic acids or encoded variant PD-1 polypeptides or immunomodulatory polypeptides, such as any of the transmembrane immunomodulatory polypeptides or secretable immunomodulatory polypeptides.

Also provided herein are infectious agents, such as bacterial or viral cells, containing any of the provided nucleic acids or encoded variant PD-1 polypeptides or immunomodulatory polypeptides, such as any of the transmembrane immunomodulatory polypeptides or secretable immunomodulatory polypeptides.

In any of the above provided embodiments, the nucleic acids encoding the immunomodulatory polypeptides provided herein can be introduced into cells using recombinant DNA and cloning techniques. To do so, a recombinant DNA molecule encoding an immunomodulatory polypeptide is prepared. Methods of preparing such DNA molecules are well known in the art. For instance, sequences coding for the peptides could be excised from DNA using suitable restriction enzymes. Alternatively, the DNA molecule could be synthesized using chemical synthesis techniques, such as the phosphoramidite method. Also, a combination of these techniques could be used. In some instances, a recombinant or synthetic nucleic acid may be generated through polymerase chain reaction (PCR). In some embodiments, a DNA insert can be generated encoding one or more variant PD-1 polypeptides containing at least one affinity-modified IgSF domain and, in some embodiments, a signal peptide, a transmembrane domain and/or an endodomain in accord with the provided description. This DNA insert can be cloned into an appropriate transduction/transfection vector as is known to those of skill in the art. Also provided are expression vectors containing the nucleic acid molecules.

In some embodiments, the expression vectors are capable of expressing the immunomodulatory proteins in an appropriate cell under conditions suited to expression of the protein. In some aspects, nucleic acid molecule or an expression vector comprises the DNA molecule that encodes the immunomodulatory protein operatively linked to appropriate expression control sequences. Methods of effecting this operative linking, either before or after the DNA molecule is inserted into the vector, are well known. Expression control sequences include promoters, activators, enhancers, operators, ribosomal binding sites, start signals, stop signals, cap signals, polyadenylation signals, and other signals involved with the control of transcription or translation.

In some embodiments, expression of the immunomodulatory protein is controlled by a promoter or enhancer to control or regulate expression. The promoter is operably linked to the portion of the nucleic acid molecule encoding the variant polypeptide or immunomodulatory protein. In some embodiments, the promotor is a constitutively active promoter (such as a tissue-specific constitutively active promotor or other constitutive promoter). In some embodiments, the promoter is an inducible promotor, which may be responsive to an inducing agent (such as a T cell activation signal).

In some embodiments, a constitutive promoter is operatively linked to the nucleic acid molecule encoding the variant polypeptide or immunomodulatory protein. Exemplary constitutive promoters include the Simian vacuolating virus 40 (SV40) promoter, the cytomegalovirus (CMV) promoter, the ubiquitin C (UbC) promoter, and the EF-1 alpha (EF1a) promoter. In some embodiments, the constitutive promoter is tissue specific. For example, in some embodiments, the promoter allows for constitutive expression of the immunomodulatory protein in specific tissues, such as immune cells, lymphocytes, or T cells. Exemplary tissue-specific promoters are described in U.S. Pat. No. 5,998,205, including, for example, a fetoprotein, DF3, tyrosinase, CEA, surfactant protein, and ErbB2 promoters.

In some embodiments, an inducible promoter is operatively linked to the nucleic acid molecule encoding the variant polypeptide or immunomodulatory protein such that expression of the nucleic acid is controllable by controlling the presence or absence of the appropriate inducer of transcription. For example, the promoter can be a regulated promoter and transcription factor expression system, such as the published tetracycline-regulated systems or other regulatable systems (see, e.g., published International PCT Appl. No. WO 01/30843), to allow regulated expression of the encoded polypeptide. An exemplary regulatable promoter system is the Tet-On (and Tet-Off) system available, for example, from Clontech (Palo Alto, CA). This promoter system allows the regulated expression of the transgene controlled by tetracycline or tetracycline derivatives, such as doxycycline. Other regulatable promoter systems are known (see, e.g., published U.S. Application No. 2002-0168714, entitled "Regulation of Gene Expression Using Single-Chain, Monomeric, Ligand Dependent Polypeptide Switches," which describes gene switches that contain ligand binding domains and transcriptional regulating domains, such as those from hormone receptors).

In some embodiments, the promotor is responsive to an element responsive to T-cell activation signaling. Solely by way of example, in some embodiments, an engineered T cell comprises an expression vector encoding the immunomodulatory protein and a promotor operatively linked to control expression of the immunomodulatory protein. The engineered T cell can be activated, for example by signaling through an engineered T cell receptor (TCR) or a chimeric antigen rector (CAR), and thereby triggering expression and secretion of the immunomodulatory protein through the responsive promotor.

In some embodiments, an inducible promoter is operatively linked to the nucleic acid molecule encoding the immunomodulatory protein such that the immunomodulatory protein is expressed in response to a nuclear factor of activated T-cells (NFAT) or nuclear factor kappa-light-chain enhancer of activated B cells (NF-κB). For example, in some embodiments, the inducible promoter comprises a binding site for NFAT or NF-κB. For example, in some embodiments, the promoter is an NFAT or NF-κB promoter or a functional variant thereof. Thus, in some embodiments, the nucleic acids make it possible to control the expression of immunomodulatory protein while also reducing or eliminating the toxicity of the immunomodulatory protein. In particular, engineered immune cells comprising the nucleic acids of the invention express and secrete the immunomodulatory protein only when the cell (e.g., a T-cell receptor (TCR) or a chimeric antigen receptor (CAR) expressed by the cell) is specifically stimulated by an antigen and/or the cell (e.g., the calcium signaling pathway of the cell) is non-specifically stimulated by, e.g., phorbol myristate acetate (PMA)/Ionomycin. Accordingly, the expression and, in some cases, secretion, of immunomodulatory protein can be controlled to occur only when and where it is needed (e.g., in the presence of an infectious disease-causing agent, cancer, or at a tumor site), which can decrease or avoid undesired immunomodulatory protein interactions.

In some embodiments, the nucleic acid encoding an immunomodulatory protein described herein comprises a suitable nucleotide sequence that encodes a NFAT promoter, NF-κB promoter, or a functional variant thereof "NFAT promoter" as used herein means one or more NFAT responsive elements linked to a minimal promoter. "NF-κB promoter" refers to one or more NF-κB responsive elements linked to a minimal promoter. In some embodiments, the minimal promoter of a gene is a minimal human IL-2 promoter or a CMV promoter. The NFAT responsive elements may comprise, e.g., NFAT1, NFAT2, NFAT3, and/or NFAT4 responsive elements. The NFAT promoter, NF-κB promoter, or a functional variant thereof may comprise any number of binding motifs, e.g., at least two, at least three, at least four, at least five, or at least six, at least seven, at least eight, at least nine, at least ten, at least eleven, or up to twelve binding motifs.

The resulting recombinant expression vector having the DNA molecule thereon is used to transform an appropriate host. This transformation can be performed using methods well known in the art. In some embodiments, a nucleic acid provided herein further comprises nucleotide sequence that encodes a secretory or signal peptide operably linked to the nucleic acid encoding an immunomodulatory polypeptide such that a resultant soluble immunomodulatory polypeptide is recovered from the culture medium, host cell, or host cell periplasm. In other embodiments, the appropriate expression control signals are chosen to allow for membrane expression of an immunomodulatory polypeptide. Furthermore, commercially available kits as well as contract manufacturing companies can also be utilized to make engineered cells or recombinant host cells provided herein.

In some embodiments, the resulting expression vector having the DNA molecule thereon is used to transform, such as transduce, an appropriate cell. The introduction can be performed using methods well known in the art. Exemplary methods include those for transfer of nucleic acids encoding the receptors, including via viral, e.g., retroviral or lentiviral, transduction, transposons, and electroporation. In some embodiments, the expression vector is a viral vector. In some embodiments, the nucleic acid is transferred into cells by lentiviral or retroviral transduction methods.

Any of a large number of publicly available and well-known mammalian host cells, including mammalian T-cells or APCs, can be used in the preparing the polypeptides or engineered cells. The selection of a cell is dependent upon a number of factors recognized by the art. These include, for example, compatibility with the chosen expression vector, toxicity of the peptides encoded by the DNA molecule, rate of transformation, ease of recovery of the peptides, expression characteristics, bio-safety and costs. A balance of these factors must be struck with the understanding that not all cells can be equally effective for the expression of a particular DNA sequence.

In some embodiments, the host cells can be a variety of eukaryotic cells, such as in yeast cells, or with mammalian cells such as Chinese hamster ovary (CHO) or HEK293 cells. In some embodiments, the host cell is a suspension cell and the polypeptide is engineered or produced in cultured suspension, such as in cultured suspension CHO cells, e.g. CHO-S cells. In some examples, the cell line is a CHO cell line that is deficient in DHFR (DHFR−), such as DG44 and DUXB11. In some embodiments, the cell is deficient in glutamine synthase (GS), e.g. CHO-S cells, CHOK1 SV cells, and CHOZN((R)) GS−/− cells. In some embodiments, the CHO cells, such as suspension CHO cells, may be CHO-S-2H2 cells, CHO-S-clone 14 cells, or ExpiCHO-S cells.

In some embodiments, host cells can also be prokaryotic cells, such as with E. coli. The transformed recombinant host is cultured under polypeptide expressing conditions, and then purified to obtain a soluble protein. Recombinant host cells can be cultured under conventional fermentation conditions so that the desired polypeptides are expressed. Such fermentation conditions are well known in the art. Finally, the polypeptides provided herein can be recovered and purified from recombinant cell cultures by any of a number of methods well known in the art, including ammonium sulfate or ethanol precipitation, acid extraction, anion or cation exchange chromatography, phosphocellulose chromatography, hydrophobic interaction chromatography, and affinity chromatography. Protein refolding steps can be used, as desired, in completing configuration of the mature protein. Finally, high performance liquid chromatography (HPLC) can be employed in the final purification steps.

In some embodiments, the cell is an immune cell, such as any described above in connection with preparing engineered cells. In some embodiments, such engineered cells are primary cells. In some embodiments, the engineered cells are autologous to the subject. In some embodiment, the engineered cells are allogeneic to the subject. In some embodiments, the engineered cells are obtained from a subject, such as by leukapheresis, and transformed ex vivo for expression of the immunomodulatory polypeptide, e.g., transmembrane immunomodulatory polypeptide or secretable immunomodulatory polypeptide.

Also provided are nucleic acids encoding any of the variant immunomodulatory polypeptides contained in infectious agents described herein. In some embodiments, the infectious agents deliver the nucleic acids to a cell in the subject, and/or permit expression of the encoded variant polypeptides in the cell. Also provided are nucleic acids that are used to generate, produce or modify such infectious agents. For example, in some embodiments, provided are vectors and/or plasmids that contain nucleic acids encoding the variant immunomodulatory polypeptides, for generation of the infectious agents, delivery to the cells in a subject and/or expression of the variant immunomodulatory polypeptides in the cells in the subject.

In some embodiments, the provided nucleic acids are recombinant viral or bacterial vectors containing nucleic acid sequences encoding the variant immunomodulatory polypeptides. In some embodiments, the recombinant vectors can be used to produce an infectious agent that contains nucleic acid sequences encoding the variant immunomodulatory polypeptides and/or to be delivered to a target cell in the subject for expression by the target cell. In some embodiments, the recombinant vector is an expression vector. In some embodiments, the recombinant vector includes appropriate sequences necessary for generation and/or production of the infectious agent and expression in the target cell.

In some embodiments, the recombinant vector is a plasmid or cosmid. Plasmid or cosmid containing nucleic acid sequences encoding the variant immunomodulatory polypeptides, as described herein, is readily constructed using standard techniques well known in the art. For generation of the infectious agent, the vector or genome can be constructed in a plasmid form that can then be transfected into a packaging or producer cell line or a host bacterium. The recombinant vectors can be generated using any of the recombinant techniques known in the art. In some embodiments, the vectors can include a prokaryotic origin of replication and/or a gene whose expression confers a detectable or selectable marker such as a drug resistance for propagation and/or selection in prokaryotic systems.

In some embodiments, the recombinant vector is a viral vector. Exemplary recombinant viral vectors include a lentiviral vector genome, poxvirus vector genome, vaccinia virus vector genome, adenovirus vector genome, adenovirus-associated virus vector genome, herpes virus vector genome, and alpha virus vector genome. Viral vectors can be live, attenuated, replication conditional or replication deficient, non-pathogenic (defective), replication competent viral vector, and/or is modified to express a heterologous gene product, e.g., the variant immunomodulatory polypeptides provided herein. Vectors for generation of viruses also can be modified to alter attenuation of the virus, which includes any method of increasing or decreasing the transcriptional or translational load.

Exemplary viral vectors that can be used include modified vaccinia virus vectors (see, e.g., Guerra et al., J. Virol. 80:985-98 (2006); Tartaglia et al., AIDS Research and Human Retroviruses 8: 1445-47 (1992); Gheradi et al., J. Gen. Virol. 86:2925-36 (2005); Mayr et al., Infection 3:6-14 (1975); Hu et al., J. Virol. 75: 10300-308 (2001); U.S. Pat. Nos. 5,698,530, 6,998,252, 5,443,964, 7,247,615 and 7,368, 116); adenovirus vector or adenovirus-associated virus vectors (see., e.g., Molin et al., J. Virol. 72:8358-61 (1998); Narumi et al., Am J. Respir. Cell Mol. Biol. 19:936-41 (1998); Mercier et al., Proc. Natl. Acad. Sci. USA 101:6188-93 (2004); U.S. Pat. Nos. 6,143,290; 6,596,535; 6,855,317; 6,936,257; 7,125,717; 7,378,087; 7,550,296); retroviral vectors including those based upon murine leukemia virus (MuLV), gibbon ape leukemia virus (GaLV), ecotropic retroviruses, simian immunodeficiency virus (SIV), human immunodeficiency virus (HIV), and combinations (see, e.g., Buchscher et al., J. Virol. 66:2731-39 (1992); Johann et al., J. Virol. 66: 1635-40 (1992); Sommerfelt et al., Virology 176:58-59 (1990); Wilson et al., J. Virol. 63:2374-78 (1989); Miller et al., J. Virol. 65:2220-24 (1991); Miller et al., Mol. Cell Biol. 10:4239 (1990); Kolberg, NIH Res. 4:43 1992; Cornetta et al., Hum. Gene Ther. 2:215 (1991)); lentiviral vectors including those based upon Human Immunodeficiency Virus (HIV-1), HIV-2, feline immunodeficiency virus (FIV), equine infectious anemia virus, Simian Immunodeficiency Virus (SIV), and maedi/visna virus (see, e.g., Pfeifer et al., Annu. Rev. Genomics Hum. Genet. 2: 177-211 (2001); Zufferey et al., J. Virol. 72: 9873, 1998; Miyoshi et al., J. Virol. 72:8150, 1998; Philpott and Thrasher, Human Gene Therapy 18:483, 2007; Engelman et al., J. Virol. 69: 2729, 1995; Nightingale et al., Mol. Therapy, I3: 1121, 2006; Brown et al., J. Virol. 73:9011 (1999); WO 2009/076524; WO 2012/141984; WO 2016/011083; McWilliams et al., J. Virol. 77: 11150, 2003; Powell et al., J. Virol. 70:5288, 1996) or any, variants thereof, and/or vectors that can be used to generate any of the viruses described above. In some embodiments, the recombinant vector can include regulatory sequences, such as promoter or enhancer sequences, that can regulate the expression of the viral genome, such as in the case for RNA viruses, in the packaging cell line (see, e.g., U.S. Pat. Nos. 5,385,839 and 5,168,062).

In some embodiments, the recombinant vector is an expression vector, e.g., an expression vector that permits expression of the encoded gene product when delivered into the target cell, e.g., a cell in the subject, e.g., a tumor cell, an immune cell and/or an APC. In some embodiments, the recombinant expression vectors contained in the infectious agent are capable of expressing the immunomodulatory proteins in the target cell in the subject, under conditions suited to expression of the protein.

In some aspects, nucleic acids or an expression vector comprises a nucleic acid sequence that encodes the immunomodulatory protein operatively linked to appropriate expression control sequences. Methods of affecting this operative linking, either before or after the nucleic acid sequence encoding the immunomodulatory protein is inserted into the vector, are well known. Expression control sequences include promoters, activators, enhancers, operators, ribosomal binding sites, start signals, stop signals, cap signals, polyadenylation signals, and other signals involved with the control of transcription or translation. The promoter can be operably linked to the portion of the nucleic acid sequence encoding the immunomodulatory protein. In some embodiments, the promotor is a constitutively active promotor in the target cell (such as a tissue-specific constitutively active promotor or other constitutive promotor). For example, the recombinant expression vector may also include, lymphoid tissue-specific transcriptional regulatory elements (TRE) such as a B lymphocyte, T lymphocyte, or dendritic cell specific TRE. Lymphoid tissue specific TRE are known in the art (see, e.g., Thompson et al., Mol. Cell. Biol. 12:1043-53 (1992); Todd et al., J. Exp. Med. 177: 1663-74 (1993); Penix et al., J. Exp. Med. 178:1483-96 (1993)). In some embodiments, the promoter is an inducible promotor, which may be responsive to an inducing agent (such as a T cell activation signal). In some embodiments, nucleic acids delivered to the target cell in the subject, e.g., tumor cell, immune cell and/or APC, can be operably linked to any of the regulatory elements described above.

In some embodiments, the vector is a bacterial vector, e.g., a bacterial plasmid or cosmid. In some embodiments, the bacterial vector is delivered to the target cell, e.g., tumor cells, immune cells and/or APCs, via bacterial-mediated transfer of plasmid DNA to mammalian cells (also referred to as "bactofection"). In some embodiments, the delivered bacterial vector also contains appropriate expression control sequences for expression in the target cells, such as a promoter sequence and/or enhancer sequences, or any regulatory or control sequences described above. In some embodiments, the bacterial vector contains appropriate expression control sequences for expression and/or secretion of the encoded variant polypeptides in the infectious agent, e.g., the bacterium.

In some embodiments, polypeptides provided herein can also be made by synthetic methods. Solid phase synthesis is the preferred technique of making individual peptides since it is the most cost-effective method of making small peptides. For example, well known solid phase synthesis techniques include the use of protecting groups, linkers, and solid phase supports, as well as specific protection and deprotection reaction conditions, linker cleavage conditions, use of scavengers, and other aspects of solid phase peptide synthesis. Peptides can then be assembled into the polypeptides as provided herein.

IV. METHODS OF ASSESSING ACTIVITY IMMUNE MODULATION OF VARIANT PD-1 POLYPEPTIDES AND IMMUNOMODULATORY PROTEINS

In some embodiments, the variant PD-1 polypeptides provided herein (e.g., full-length and/or specific binding fragments or conjugates, stack constructs or fusion thereof or engineered cells) exhibit immunomodulatory activity to modulate T cell activation. In some embodiments, PD-1 polypeptides modulate cytokine production, e.g. IFN-gamma or IL-2 expression, in a T cell assay relative to a wild-type or unmodified PD-1 control. In some cases, modulation of cytokine can be an increase or decrease of cytokine levels, e.g. IFN-gamma or IL-2 expression, relative to the control. Assays to assess cytokine production, e.g. IFN-gamma or IL-2 expression, are well-known in the art and include the MLR (mixed lymphocyte reaction) assays measuring cytokine levels in culture supernatants (Wang et al., Cancer Immunol Res. 2014 September: 2(9):846-56), SEB (staphylococcal enterotoxin B) T cell stimulation assay (Wang et al., Cancer Immunol Res. 2014 September: 2(9): 846-56), and anti-CD3 T cell stimulation assays (Li and Kurlander, J Transl Med. 2010: 8: 104).

In some embodiments, a variant PD-1 polypeptide can in some embodiments increase or, in alternative embodiments, decrease cytokine production, e.g. IFN-gamma (interferon-gamma) or IL-2 expression, in a primary T-cell assay relative to a wild-type PD-1 control. In some embodiments, such activity may depend on whether the variant PD-1 polypeptide is provided in a form for antagonist activity or in a form for agonist or blocking activity. In some embodiments, a variant PD-1 polypeptide or immunomodulatory protein blocks an inhibitory signal in the cell that may occur to decrease response to an activating stimuli, e.g., CD3 and/or CD28 costimulatory signal or a mitogenic signal. Those of skill will recognize that different formats of the primary T-cell assay used to determine an increase or decrease in cytokine production, e.g. IFN-gamma or IL-2 expression, exist. In assaying for the ability of a variant PD-1 to increase or decrease cytokine production, e.g. IFN-gamma or IL-2 expression, in a primary T-cell assay, a Mixed Lymphocyte Reaction (MLR) assay can be used. Alternatively, in assaying for the ability of a variant PD-1 to modulate an increase or decrease in cytokine production, e.g. IFN-gamma or IL-2 expression, in a primary T-cell assay, a co-immobilization assay can be used. In a co-immobilization assay, a TCR signal, provided in some embodiments by anti-CD3 antibody, is used in conjunction with a co-immobilized variant PD-1 to determine the ability to increase or decrease cytokine production, e.g. IFN-gamma or IL-2 expression, relative to a PD-1 unmodified or wild-type control.

In some embodiments, in assaying for the ability of a variant PD-1 to modulate an increase or decrease in cytokine production, e.g. IFN-gamma or IL-2 expression, a T cell reporter assay can be used. In some embodiments, the T cell is a Jurkat T cell line or is derived from Jurkat T cell lines. In some embodiments, the reporter T cells also contain a reporter construct containing an inducible promoter responsive to T cell activation operably linked to a reporter. In some embodiments, the reporter is a fluorescent or luminescent reporter. In some embodiments, the reporter is luciferase. In some embodiments, the promoter is responsive to CD3 signaling. In some embodiments, the promoter is an NFAT promoter. In some embodiments, the promoter is responsive to costimulatory signaling, e.g. CD28 costimulatory signaling. In some embodiments, the promoter is an IL-2 promoter. In aspects of a reporter assay, a reporter cell line is stimulated, such as by co-incubation with antigen presenting cells (APCs) expressing the wild-type ligand of the inhibitory receptor, e.g. PD-L1. In some embodiments, the APCs are artificial APCs. Artificial APCs are well known to a skilled artisan. In some embodiments, artificial APCs are derived from one or more mammalian cell line, such as K562, CHO or 293 cells. In some embodiments, the Jurkat reporter cells are co-incubated with artificial APCs overexpressing the inhibitory ligand in the presence of the variant IgSF domain molecule or immunomodulatory protein, e.g., variant PD-1 polypeptide or immunomodulatory protein. In some embodiments, reporter expression is monitored, such as by determining the luminescence or fluorescence of the cells. In some embodiments, normal interactions between its inhibitory receptor and ligand result in a repression of or decrease in the reporter signal, such as compared to control, e.g., reporter expression by co-incubation of control T cells and APCs in which the inhibitory receptor and ligand interaction is not present, e.g., APCs that do not overexpress PD-L1. In some embodiments, a variant PD-1 polypeptide or immunomodulatory protein provided herein blocks the PD-1/PD-L1 interaction, e.g., when provided in soluble form as a variant PD-1-Fc or when expressed from the APC as a secretable immunomodulatory protein, thereby resulting in an increase in the reporter signal compared to the absence of the variant PD-1 polypeptide or immunomodulatory protein.

Use of proper controls is known to those of skill in the art, however, in the aforementioned embodiments, a control typically involves use of the unmodified PD-1, such as a wild-type of native PD-1 isoform from the same mammalian species from which the variant PD-1 was derived or developed. In some embodiments, the wild-type or native PD-1 is of the same form or corresponding form as the variant. For example, if the variant PD-1 is a soluble form containing a variant ECD fused to an Fc protein, then the control is a soluble form containing the wild-type or native ECD of PD-1 fused to the Fc protein. Irrespective of whether the binding affinity and/or selectivity to either one or more of PD-L1 and PD-L2 is increased or decreased, a variant PD-1 in some embodiments will increase cytokine production, e.g. IFN-gamma expression or IL-2, and, in alternative embodiments, decrease cytokine production, e.g. IFN-gamma or IL-2, expression in a T-cell assay relative to a wild-type PD-1 control.

In some embodiments, a variant PD-1 polypeptide or immunomodulatory protein, increases cytokine production, e.g. IFN-gamma expression or IL-2 expression, (i.e., protein expression) relative to a wild-type or unmodified PD-1 control by at least: 5%, 10%, 20%, 30%, 40%, 50%, 60%, 70%, 80%, 90%, or higher. In other embodiments, a variant PD-1 or immunomodulatory protein decreases cytokine production, e.g. IFN-gamma or IL-2 expression, (i.e. protein expression) relative to a wild-type or unmodified PD-1 control by at least: 5%, 10%, 20%, 30%, 40%, 50%, 60%, 70%, 80%, 90%, or higher. In some embodiments, the wild-type PD-1 control is murine PD-1, such as would typically be used for a variant PD-1 altered in sequence from that of a wild-type murine PD-1 sequence. In some embodiments, the wild-type PD-1 control is human PD-1, such as would typically be used for a variant PD-1 altered in sequence from that of a wild-type human PD-1 sequence such as an PD-1 sequence comprising the sequence of amino acids of SEQ ID NO: 37, 392, or 457, or SEQ ID NO: 244.

V. PHARMACEUTICAL FORMULATIONS

Provided herein are compositions containing any of the variant PD-1 polypeptides, immunomodulatory proteins, conjugates, engineered cells or infectious agents described herein. The pharmaceutical composition can further comprise a pharmaceutically acceptable excipient. For example, the pharmaceutical composition can contain one or more excipients for modifying, maintaining or preserving, for example, the pH, osmolarity, viscosity, clarity, color, isotonicity, odor, sterility, stability, rate of dissolution or release, adsorption, or penetration of the composition. In some aspects, a skilled artisan understands that a pharmaceutical composition containing cells may differ from a pharmaceutical composition containing a protein.

In some embodiments, the pharmaceutical composition is a solid, such as a powder, capsule, or tablet. For example, the components of the pharmaceutical composition can be lyophilized. In some embodiments, the solid pharmaceutical composition is reconstituted or dissolved in a liquid prior to administration.

In some embodiments, the pharmaceutical composition is a liquid, for example variant PD-1 polypeptides dissolved in an aqueous solution (such as physiological saline or Ringer's solution). In some embodiments, the pH of the pharmaceutical composition is between about 4.0 and about 8.5 (such as between about 4.0 and about 5.0, between about 4.5 and about 5.5, between about 5.0 and about 6.0, between about 5.5 and about 6.5, between about 6.0 and about 7.0, between about 6.5 and about 7.5, between about 7.0 and about 8.0, or between about 7.5 and about 8.5).

In some embodiments, the pharmaceutical composition comprises a pharmaceutically-acceptable excipient, for example a filler, binder, coating, preservative, lubricant, flavoring agent, sweetening agent, coloring agent, a solvent, a buffering agent, a chelating agent, or stabilizer. Examples of pharmaceutically-acceptable fillers include cellulose, dibasic calcium phosphate, calcium carbonate, microcrystalline cellulose, sucrose, lactose, glucose, mannitol, sorbitol, maltol, pregelatinized starch, corn starch, or potato starch. Examples of pharmaceutically-acceptable binders include polyvinylpyrrolidone, starch, lactose, xylitol, sorbitol, maltitol, gelatin, sucrose, polyethylene glycol, methyl cellulose, or cellulose. Examples of pharmaceutically-acceptable coatings include hydroxypropyl methylcellulose (HPMC), shellac, corn protein zein, or gelatin. Examples of pharmaceutically-acceptable disintegrants include polyvinylpyrrolidone, carboxymethyl cellulose, or sodium starch glycolate. Examples of pharmaceutically-acceptable lubricants include polyethylene glycol, magnesium stearate, or stearic acid. Examples of pharmaceutically-acceptable preservatives include methyl parabens, ethyl parabens, propyl paraben, benzoic acid, or sorbic acid. Examples of pharmaceutically-acceptable sweetening agents include sucrose, saccharine, aspartame, or sorbitol. Examples of pharmaceutically-acceptable buffering agents include carbonates, citrates, gluconates, acetates, phosphates, or tartrates.

In some embodiments, the pharmaceutical composition further comprises an agent for the controlled or sustained release of the product, such as injectable microspheres, bio-erodible particles, polymeric compounds (polylactic acid, polyglycolic acid), beads, or liposomes.

In some embodiments, the pharmaceutical composition is sterile. Sterilization may be accomplished by filtration through sterile filtration membranes or radiation. Where the composition is lyophilized, sterilization using this method may be conducted either prior to or following lyophilization and reconstitution. The composition for parenteral administration may be stored in lyophilized form or in solution. In addition, parenteral compositions generally are placed into a container having a sterile access port, for example, an intravenous solution bag or vial having a stopper pierceable by a hypodermic injection needle.

In some embodiments, provided are pharmaceutical compositions containing the transmembrane immunomodulatory proteins, including engineered cells expressing such transmembrane immunomodulatory proteins. In some embodiments, the pharmaceutical compositions and formulations include one or more optional pharmaceutically acceptable carrier or excipient. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions of the present invention are preferably formulated for intravenous administration.

In some embodiments, the pharmaceutical composition contains infectious agents containing nucleic acid sequences encoding the immunomodulatory variant polypeptides. In some embodiments, the pharmaceutical composition contains a dose of infectious agents suitable for administration to a subject that is suitable for treatment. In some embodiments, the pharmaceutical composition contains an infectious agent that is a virus, at a single or multiple dosage amount, between about or between about $1 \times 10^5$ and about $1 \times 10^{12}$ plaque-forming units (pfu), $1 \times 10^6$ and $1 \times 10^{10}$ pfu, or $1 \times 10^7$ and $1 \times 10^{10}$ pfu, each inclusive, such as at least or at least about or at about $1 \times 10^6$, $1 \times 10^7$, $1 \times 10^8$, $1 \times 10^9$, $2 \times 10^9$, $3 \times 10^9$, $4 \times 10^9$, $5 \times 10^9$ pfu or about $1 \times 10^{10}$ pfu. In some embodiments, the pharmaceutical composition can contain a virus concentration of from or from about $10^5$ to about $10^{10}$ pfu/mL, for example, $5 \times 10^6$ to $5 \times 10^9$ or $1 \times 10^7$ to $1 \times 10^9$ pfu/mL, such as at least or at least about or at about $10^6$ pfu/mL, $10^7$ pfu/mL, $10^8$ pfu/mL or $10^9$ pfu/mL. In some embodiments, the pharmaceutical composition contains an infectious agent that is a bacterium, at a single or multiple dosage amount, of between about between or between about $1 \times 10^3$ and about $1 \times 10^9$ colony-forming units (cfu), $1 \times 10^4$ and $1 \times 10^9$ cfu, or $1 \times 10^5$ and $1 \times 10^7$ cfu, each inclusive, such as at least or at least about or at about $1 \times 10^4$, $1 \times 10^5$, $1 \times 10^6$, $1 \times 10^7$, $1 \times 10^8$ or $1 \times 10^9$ cfu. In some embodiments, the pharmaceutical composition can contain a bacterial concentration of from or from about $10^3$ to about $10^8$ cfu/mL, for example, $5 \times 10^5$ to $5 \times 10^7$ or $1 \times 10^6$ to $1 \times 10^7$ cfu/mL, such as at least or at least about or at about $10^5$ cfu/mL, $10^6$ cfu/mL, $10^7$ cfu/mL or $10^8$ cfu/mL Such a formulation may, for example, be in a form suitable for intravenous infusion. A pharmaceutically acceptable carrier may be a pharmaceutically acceptable material, composition, or vehicle that is involved in carrying or transporting cells of interest from one tissue, organ, or portion of the body to another tissue, organ, or portion of the body. For example, the carrier may be a liquid or solid filler, diluent, excipient, solvent, or encapsulating material, or some combination thereof. Each component of the carrier must be "pharmaceutically acceptable" in that it must be compatible with the other ingredients of the formulation. It also must be suitable for contact with any tissue, organ, or portion of the body that it may encounter, meaning that it must not carry a risk of toxicity, irritation, allergic response, immunogenicity, or any other complication that excessively outweighs its therapeutic benefits.

In some embodiments, the pharmaceutical composition is administered to a subject. Generally, dosages and routes of administration of the pharmaceutical composition are determined according to the size and condition of the subject, according to standard pharmaceutical practice. For example, the therapeutically effective dose can be estimated initially either in cell culture assays or in animal models such as mice, rats, rabbits, dogs, pigs, or monkeys. An animal model may also be used to determine the appropriate concentration range and route of administration. Such information can then be used to determine useful doses and routes for administration in humans. The exact dosage will be determined in light of factors related to the subject requiring treatment. Dosage and administration are adjusted to provide sufficient levels of the active compound or to maintain the desired effect. Factors that may be taken into account include the severity of the disease state, the general health of the subject, the age, weight, and gender of the subject, time and frequency of administration, drug combination(s), reaction sensitivities, and response to therapy.

Long-acting pharmaceutical compositions may be administered every 3 to 4 days, every week, or biweekly depending on the half-life and clearance rate of the particular formulation. The frequency of dosing will depend upon the pharmacokinetic parameters of the molecule in the formulation used. Typically, a composition is administered until a dosage is reached that achieves the desired effect. The composition may therefore be administered as a single dose, or as multiple doses (at the same or different concentrations/dosages) over time, or as a continuous infusion. Further refinement of the appropriate dosage is routinely made. Appropriate dosages may be ascertained through use of appropriate dose-response data. A number of biomarkers or physiological markers for therapeutic effect can be monitored including T cell activation or proliferation, cytokine synthesis or production (e.g., production of TNF-α, IFN-γ, IL-2), induction of various activation markers (e.g., CD25, IL-2 receptor), inflammation, joint swelling or tenderness, serum level of C-reactive protein, anti-collagen antibody production, and/or T cell-dependent antibody response(s).

In some embodiments, the pharmaceutical composition is administered to a subject through any route, including orally, transdermally, by inhalation, intravenously, intra-arterially, intramuscularly, direct application to a wound site, application to a surgical site, intraperitoneally, by suppository, subcutaneously, intradermally, transcutaneously, by nebulization, intrapleurally, intraventricularly, intra-articularly, intraocularly, or intraspinally.

In some embodiments, the dosage of the pharmaceutical composition is a single dose or a repeated dose. In some embodiments, the doses are given to a subject once per day, twice per day, three times per day, or four or more times per day. In some embodiments, about 1 or more (such as about 2 or more, about 3 or more, about 4 or more, about 5 or more, about 6 or more, or about 7 or more) doses are given in a week. In some embodiments, multiple doses are given over the course of days, weeks, months, or years. In some embodiments, a course of treatment is about 1 or more doses (such as about 2 or more does, about 3 or more doses, about 4 or more doses, about 5 or more doses, about 7 or more doses, about 10 or more doses, about 15 or more doses, about 25 or more doses, about 40 or more doses, about 50 or more doses, or about 100 or more doses).

In some embodiments, an administered dose of the pharmaceutical composition is about 1 µg of protein per kg subject body mass or more (such as about 2 µg of protein per kg subject body mass or more, about 5 µg of protein per kg subject body mass or more, about 10 µg of protein per kg subject body mass or more, about 25 µg of protein per kg subject body mass or more, about 50 µg of protein per kg subject body mass or more, about 100 µg of protein per kg subject body mass or more, about 250 µg of protein per kg subject body mass or more, about 500 µg of protein per kg subject body mass or more, about 1 mg of protein per kg subject body mass or more, about 2 mg of protein per kg subject body mass or more, or about 5 mg of protein per kg subject body mass or more).

In some embodiments, a therapeutic amount of a cell composition is administered. Typically, precise amount of the compositions of the present invention to be administered can be determined by a physician with consideration of individual differences in age, weight, tumor size, extent of infection or metastasis, and condition of the patient (subject). It can generally be stated that a pharmaceutical composition comprising engineered cells, e.g., T cells, as described herein may be administered at a dosage of $10^4$ to $10^9$ cells/kg body weight, such as $10^5$ to $10^6$ cells/kg body weight, including all integer values within those ranges. Engineered cell compositions, such as T cell compositions, may also be administered multiple times at these dosages. The cells can be administered by using infusion techniques that are commonly known in immunotherapy (see, e.g., Rosenberg et al, New Eng. J. of Med. 319: 1676, 1988). The optimal dosage and treatment regime for a particular patient can readily be determined by one skilled in the art of medicine by monitoring the patient for signs of disease and adjusting the treatment accordingly.

A variety of means are known for determining if administration of a therapeutic composition of the invention sufficiently modulates immunological activity by eliminating, sequestering, or inactivating immune cells mediating or capable of mediating an undesired immune response; inducing, generating, or turning on immune cells that mediate or are capable of mediating a protective immune response; changing the physical or functional properties of immune cells; or a combination of these effects. Examples of measurements of the modulation of immunological activity include, but are not limited to, examination of the presence or absence of immune cell populations (using flow cytometry, immunohistochemistry, histology, electron microscopy, polymerase chain reaction (PCR)); measurement of the functional capacity of immune cells including ability or resistance to proliferate or divide in response to a signal (such as using T-cell proliferation assays and pepscan analysis based on 3H-thymidine incorporation following stimulation with anti-CD3 antibody, anti-T-cell receptor antibody, anti-CD28 antibody, calcium ionophores, PMA (phorbol 12-myristate 13-acetate) antigen presenting cells loaded with a peptide or protein antigen; B cell proliferation assays); measurement of the ability to kill or lyse other cells (such as cytotoxic T cell assays); measurements of the cytokines, chemokines, cell surface molecules, antibodies and other products of the cells (e.g., by flow cytometry, enzyme-linked immunosorbent assays, Western blot analysis, protein microarray analysis, immunoprecipitation analysis); measurement of biochemical markers of activation of immune cells or signaling pathways within immune cells (e.g., Western blot and immunoprecipitation analysis of tyrosine, serine or threonine phosphorylation, polypeptide cleavage, and formation or dissociation of protein complexes; protein array analysis; DNA transcriptional, profiling using DNA arrays or subtractive hybridization); measurements of cell death by apoptosis, necrosis, or other mechanisms (e.g., annexin V staining, TUNEL assays, gel electrophoresis to measure DNA laddering, histology; fluorogenic caspase assays, Western blot analysis of caspase substrates); measurement of the genes, proteins, and other molecules produced by immune cells (e.g., Northern blot analysis, polymerase chain reaction, DNA microarrays, protein microarrays, 2-dimensional gel electrophoresis, Western blot analysis, enzyme linked immunosorbent assays, flow cytometry); and measurement of clinical symptoms or outcomes such as improvement of autoimmune, neurodegenerative, and other diseases involving self-proteins or self-polypeptides (clinical scores, requirements for use of additional therapies, functional status, imaging studies) for example, by measuring relapse rate or disease severity (using clinical scores known to the ordinarily skilled artisan) in the case of multiple sclerosis, measuring blood glucose in the case of type I diabetes, or joint inflammation in the case of rheumatoid arthritis.

VI. ARTICLES OF MANUFACTURE AND KITS

Also provided herein are articles of manufacture comprising the pharmaceutical compositions described herein in suitable packaging. Suitable packaging for compositions (such as ophthalmic compositions) described herein are known in the art, and include, for example, vials (such as sealed vials), vessels, ampules, bottles, jars, flexible packaging (e.g., sealed Mylar or plastic bags), and the like. These articles of manufacture may further be sterilized and/or sealed.

Further provided are kits comprising the pharmaceutical compositions (or articles of manufacture) described herein, which may further comprise instruction(s) on methods of using the composition, such as uses described herein. The kits described herein may also include other materials desirable from a commercial and user standpoint, including other buffers, diluents, filters, needles, syringes, and package inserts with instructions for performing any methods described herein.

VII. THERAPEUTIC APPLICATIONS

The pharmaceutical compositions described herein (including pharmaceutical composition comprising the variant PD-1 polypeptides, the immunomodulatory proteins, the conjugates, the engineered cells and the infectious agents described herein) can be used in a variety of therapeutic applications, such as the treatment of a disease. For example, in some embodiments the pharmaceutical composition is used to treat oncology indications for treating a cancer or for treating viral infections or bacterial infections. The pharmaceutical composition can modulate (e.g., increase) an immune response to treat the disease.

Provided herein are methods using the provided pharmaceutical compositions containing a variant PD-1 polypeptides immunomodulatory protein, engineered cell or infectious agent described herein, for modulating an immune response, including in connection with treating a disease or condition in a subject, such as in a human patient. The pharmaceutical compositions described herein (including pharmaceutical composition comprising the variant PD-1 polypeptides, the immunomodulatory proteins, the conjugates, and the engineered cells described herein) can be used in a variety of therapeutic applications, such as the treatment of a disease. For example, in some embodiments the pharmaceutical composition is used to treat inflammatory or autoimmune disorders, cancer, organ transplantation, viral infections, and/or bacterial infections in a mammal. The pharmaceutical composition can modulate (e.g., increase or decrease) an immune response to treat the disease. In some embodiments, the methods are carried out with variant PD-1 polypeptides in a format to increase an immune response in a subject. In some such aspects, increasing an immune response treats a disease or condition in the subject, such as a tumor or cancer. In some embodiments, the methods are carried out with variant PD-1 polypeptides in a format to decrease an immune response in a subject. In some such aspects, decreasing an immune response treats a disease or condition in a subject, such as an inflammatory disease or condition, e.g. an autoimmune disease.

In some embodiments, the provided methods are applicable to therapeutic administration of variant PD-1 polypeptides, the immunomodulatory proteins, the conjugates, the engineered cells and infectious agents described herein. It is within the level of a skilled artisan, in view of the provided disclosure, to choose a format for the indication depending on the type of modulation of the immune response, e.g., increase or decrease that is desired.

There is provided methods of increasing an immune response by delivery of a variant PD-1 polypeptide that binds to PD-L1, such as binds PD-L1 with increased affinity compared to an unmodified or wildtype PD-1 polypeptide. In some embodiments, the provided PD-1 polypeptides, e.g., soluble forms of the variant PD-1 polypeptides provided herein, are capable of binding the PD-L1 on a tumor cell or APC, thereby blocking the interaction of PD-L1 and the PD-1 inhibitory receptor to prevent the negative regulatory signaling that would have otherwise resulted from the PD-L1/PD-1 interaction. In some cases, the result of this can be to increase the immune response, which, in some aspects, can treat a disease or condition in the subject, such as treatment of a tumor or cancer. Exemplary soluble formats include any as described. Included among such therapeutic agents are formats in which an extracellular portion of a PD-1 variant polypeptide containing an affinity modified IgSF domain (e.g. IgV) is linked, directly or indirectly, to a multimerization domain, e.g. an Fc domain or region. In some embodiments, such a therapeutic agent is a variant PD-1-Fc fusion protein.

Also among provided embodiments are methods for mediating agonism of CD28 by PD-L1 dependent CD28 costimulation using immunomodulatory proteins containing any of the variant PD-1 polypeptides provided herein linked, directly or indirectly, to a CD28-binding molecule, e.g. a polypeptide containing an IgSF domain of ICOSL, CD80 or CD86 as described. In some aspects, such methods can be used to increase an immune response in a subject administered the molecules, which, in some aspects, can treat a disease or condition in the subject, such as treatment of a tumor or cancer. Among such methods are methods carried out by delivery of such an immunomodulatory protein in a soluble format, including Fc-fusion proteins. In some embodiments, such a therapeutic agent is a variant PD-1/ICOSL-Fc fusion protein, variant PD-1/CD80-Fc fusion protein or variant PD-1/CD86-Fc fusion protein. In some cases, such immunomodulatory proteins also can facilitate promotion of an immune response in connection with the provided therapeutic methods by blocking the PD-L1/PD-1 interaction while also binding and co-stimulating a CD28 receptor on a localized T cell.

In some embodiments, the pharmaceutical composition can be used to inhibit growth of mammalian cancer cells (such as human cancer cells). A method of treating cancer can include administering an effective amount of any of the pharmaceutical compositions described herein to a subject with cancer. The effective amount of the pharmaceutical composition can be administered to inhibit, halt, or reverse progression of cancers, including cancers that are sensitive to modulation of immunological activity, such as by the provided variants or immunomodulatory proteins. Human cancer cells can be treated in vivo, or ex vivo. In ex vivo treatment of a human patient, tissue or fluids containing cancer cells are treated outside the body and then the tissue or fluids are reintroduced back into the patient. In some embodiments, the cancer is treated in a human patient in vivo by administration of the therapeutic composition into the patient. Thus, the present invention provides ex vivo and in vivo methods to inhibit, halt, or reverse progression of the tumor, or otherwise result in a statistically significant increase in progression-free survival (i.e., the length of time during and after treatment in which a patient is living with cancer that does not get worse), or overall survival (also called "survival rate;" i.e., the percentage of people in a study or treatment group who are alive for a certain period of time after they were diagnosed with or treated for cancer) relative to treatment with a control.

The cancers that can be treated by the pharmaceutical compositions and the treatment methods described herein include, but are not limited to, melanoma, bladder cancer, hematological malignancies (leukemia, lymphoma, myeloma), liver cancer, brain cancer, renal cancer, breast cancer, pancreatic cancer (adenocarcinoma), colorectal cancer, lung cancer (small cell lung cancer and non-small-cell lung cancer), spleen cancer, cancer of the thymus or blood cells (i.e., leukemia), prostate cancer, testicular cancer, ovarian cancer, uterine cancer, a musculoskeletal cancer, a head and neck cancer, a gastrointestinal cancer, a germ cell cancer, or an endocrine and neuroendocrine cancer. In some embodiments, the cancer is Ewing's sarcoma. In some embodiments, the cancer is selected from melanoma, lung cancer, bladder cancer, and a hematological malignancy. In some embodiments, the cancer is a lymphoma, lymphoid leukemia, myeloid leukemia, cervical cancer, neuroblastoma, or multiple myeloma.

In some embodiments, the pharmaceutical composition is administered as a monotherapy (i.e., as a single agent) or as a combination therapy (i.e., in combination with one or more additional anticancer agents, such as a chemotherapeutic drug, a cancer vaccine, or an immune checkpoint inhibitor. In some embodiments, the pharmaceutical composition can also be administered with radiation therapy. In some aspects of the present disclosure, the immune checkpoint inhibitor is nivolumab, tremelimumab, pembrolizumab, ipilimumab, or the like.

Pharmaceutical compositions comprising engineered cells and the methods described herein can be used in adoptive cell transfer applications. In some embodiments, cell compositions comprising engineered cells can be used in associated methods to, for example, modulate immunological activity in an immunotherapy approach to the treatment of, for example, a mammalian cancer or, in other embodiments the treatment of autoimmune disorders. The methods employed generally comprise a method of contacting a TIP of the present invention with a mammalian cell under conditions that are permissive to specific binding of the affinity modified IgSF domain and modulation of the immunological activity of the mammalian cell. In some embodiments, immune cells (such as tumor infiltrating lymphocytes (TILs), T-cells (including CD8+ or CD4+ T-cells), or APCs) are engineered to express as a membrane protein and/or as a soluble variant PD-1 polypeptide, immunomodulatory protein, or conjugate as described herein. The engineered cells can then be contact a mammalian cell, such as an APC, a second lymphocyte or tumor cell in which modulation of immunological activity is desired under conditions that are permissive of specific binding of the affinity modified IgSF domain to a counter-structure on the mammalian cell such that immunological activity can be modulated in the mammalian cell. Cells can be contacted in vivo or ex vivo.

In some embodiments, the engineered cells are autologous cells. In other embodiments, the cells are allogeneic. In some embodiments, the cells are autologous engineered cells reinfused into the mammal from which it was isolated. In some embodiments, the cells are allogenic engineered cells infused into the mammal. In some embodiments, the cells are harvested from a patient's blood or tumor, engineered to express a polypeptide (such as the variant PD-1 polypeptide, immunomodulatory protein, or conjugate as described herein), expanded in an in vitro culture system (for example, by stimulating the cells), and reinfused into the patient to mediate tumor destruction. In some embodiments, the methods are conducted by adoptive cell transfer wherein cells expressing the TIP (e.g., a T-cell) are infused back into the patient. In some embodiments, the therapeutic compositions and methods of the invention are used in the treatment of a mammalian patient of cancers such as lymphoma, lymphoid leukemia, myeloid leukemia, cervical cancer, neuroblastoma, or multiple myeloma.

Subjects for Treatment

In some embodiments, the provided methods are for treating a subject that is or is suspected of having the disease or condition for which the therapeutic application is directed. In some cases, the subject for treatment can be selected prior to treatment based on one or more features or parameters, such as to determine suitability for the therapy or to identify or select subjects for treatment in accord with any of the provided embodiments, including treatment with any of the provided variant PD-1 polypeptides, immunomodulatory proteins, conjugates, engineered cells or infectious agents.

In some aspects, a subject is selected for treatment if at or immediately prior to the time of the administration of the pharmaceutical composition containing a variant PD-1 polypeptide as described the subject has relapsed following remission after treatment with, or become refractory to, or is non-responsive to treatment with an antagonist of PD-1/PD-L1 or PD-1/PD-L2. In some embodiments, the antagonist is one that does not compete for binding to PD-L1 with a provided variant PD-1 polypeptide to be used in the treatment methods. In some embodiments, the antagonist is an anti-PD-1 antibody. Exemplary anti-PD-1 antibodies are known and include, but are not limited to, nivolumab or pembrolizumab, or antigen binding fragments thereof.

In some embodiments, provided methods include diagnostic, prognostic or monitoring methods utilizing binding assays on various biological samples of patients having a disease or condition in which is known, suspected or that may be a candidate for treatment in accord with the provided embodiments. In some embodiments, the methods are carried out with reagents capable of detecting CD28 and/or PD-L1 to select subjects having tumors or tumor cell infiltrates that express one or more binding partner of the variant PD-1 polypeptide or immunomodulatory protein containing a variant PD-1 polypeptide and CD28-binding molecule to be utilized in the therapeutic methods. Such reagents can be used as companion diagnostics for selecting subjects that are most likely to benefit from treatment with the provided molecules or pharmaceutical compositions and/or for predicting efficacy of the treatment.

In some embodiments, methods are provided for selecting subjects and/or predicting efficacy of treatment with provided therapies based on activity to antagonize PD-L1/PD-1 interaction and/or based on CD28 agonism, such as PD-L1- dependent CD28 costimulation, including in methods for increasing an immune response for treating a disease or condition and/or for treating a tumor or cancer. In some embodiments, the reagent is a PD-L1-binding reagent that specifically binds to PD-L1 on the surface of a cell, such as on the surface of a tumor cell or myeloid cells present in the tumor environment. In some embodiments, the reagent is a CD28-binding reagent that specifically binds to CD28 on the surface of a cell, such as on the surface of an infiltrating immune cell, such as a lymphocyte, e.g. a T cell. In some embodiments, the binding reagent can be an antibody or antigen-binding fragment, protein ligand or binding partner, an aptamer, an affimer, a peptide or a hapten. In some embodiments, such reagents can be used as a companion diagnostic for selecting or identifying subjects for treatment with a therapeutic agent or pharmaceutical composition provided herein containing a variant PD-1 polypeptide that is or contains an IgSF domain (e.g. IgV) that exhibits increased binding to PD-L1 compared to the unmodified or wild-type PD-1, including immunomodulatory proteins or conjugates.

In some embodiments, the binding reagent is an antibody or an antigen binding fragment thereof that specifically binds PD-L1. Various companion diagnostic reagents for detecting PD-L1, including intracellular or extracellular PD-L1, are known, e.g. Roach et al. (2016) Appl. Immunohistochem., Mol. Morphol., 24:392-397; Cogswell et al. (2017) Mol. Diagn. Ther. 21:85-93; International published patent application No. WO2015/181343 or WO2017/085307, or U.S. published patent application No. US2016/0009805 or US2017/0285037. Non limiting examples of anti-PD-L1 antibodies include, but are not limited to, mouse anti-PD-L1 clone 22C3 (Merck & Co.), rabbit anti-PD-L1 clone 28-8 (Bristol-Myers Squibb), rabbit anti-PD-L1 clones SP263 or SP142 (Spring Biosciences) and rabbit anti-PD-L1 antibody clone E1L3N. Such binding reagents can be used in histochemistry methods, including those available as Dako PD-L1 IHC 22C3 pharmDx assay, PD-L1 IHC 28-8 pharmDx assay, Ventana PD-L1 (SP263) assay, or Ventana PD-L1 (SP142) assay.

The binding reagent can be conjugated, such as fused, directly or indirectly to a detectable label for detection. In some cases, the binding reagent is linked or attached to a moiety that permits either direct detection or detection via secondary agents, such as via antibodies that bind to the reagent or a portion of the reagent and that are coupled to a detectable label. Exemplary detectable labels include, for example, chemiluminescent moieties, bioluminescent moieties, fluorescent moieties, radionuclides, and metals. Methods for detecting labels are well known in the art. Such a label can be detected, for example, by visual inspection, by fluorescence spectroscopy, by reflectance measurement, by flow cytometry, by X-rays, by a variety of magnetic resonance methods such as magnetic resonance imaging (MRI) and magnetic resonance spectroscopy (MRS). Methods of detection also include any of a variety of tomographic methods including computed tomography (CT), computed axial tomography (CAT), electron beam computed tomography (EBCT), high resolution computed tomography (HRCT), hypocycloidal tomography, positron emission tomography (PET), single-photon emission computed tomography (SPECT), spiral computed tomography, and ultrasonic tomography. Exemplary detectable labels include, for example, chemiluminescent moieties, bioluminescent moieties, fluorescent moieties, radionuclides, and metals. Among detectable labels are fluorescent probes or detectable enzymes, e.g. horseradish peroxidase.

The binding reagents can detect the binding partner, e.g. PD-L1 and/or CD28, using any binding assay known to one of skill in the art including, in vitro or in vivo assays. Exemplary binding assays that can be used to assess, evaluate, determine, quantify and/or otherwise specifically detect expression or levels of a binding partner, e.g. PD-L1 and/or CD28, in a sample include, but are not limited to, solid phase binding assays (e.g. enzyme linked immunosorbent assay (ELISA)), radioimmunoassay (RIA), immunoradiometric assay, fluorescence assay, chemiluminescent assay, bioluminescent assay, western blot and histochemistry methods, such as immunohistochemistry (IHC) or pseudo immunohistochemistry using a non-antibody binding agent. In solid phase binding assay methods, such as ELISA methods, for example, the assay can be a sandwich format or a competitive inhibition format. In other examples, in vivo imaging methods can be used. The binding assay can be performed on samples obtained from a patient body fluid, cell or tissue sample of any type, including from plasma, urine, tumor or suspected tumor tissues (including fresh, frozen, and fixed or paraffin embedded tissue), lymph node or bone marrow. In exemplary methods to select a subject for treatment in accord with the therapeutic methods provided herein, harvesting of the sample, e.g. tumor tissue, is carried out prior to treatment of the subject.

In some embodiments, the binding assay is a tissue staining assay to detect the expression or levels of a binding partner in a tissue or cell sample. Tissue staining methods include, but are not limited to, cytochemical or histochemical methods, such as immunohistochemistry (IHC) or histochemistry using a non-antibody binding agent (e.g. pseudo immunohistochemistry). Such histochemical methods permit quantitative or semi-quantitative detection of the amount of the binding partner in a sample, such as a tumor tissue sample. In such methods, a tissue sample can be contacted with a binding reagent, e.g. PD-L1 binding reagent, and in particular one that is detectably labeled or capable of detection, under conditions that permit binding to a tissue- or cell-associated binding partner.

A sample for use in the methods provided herein as determined by histochemistry can be any biological sample that is associated with the disease or condition, such as a tissue or cellular sample. For example, a tissue sample can be solid tissue, including a fresh, frozen and/or preserved organ or tissue sample or biopsy or aspirate, or cells. In some examples, the tissue sample is tissue or cells obtained from a solid tumor, such as primary and metastatic tumors, including but not limited to, breast, colon, rectum, lung, stomach, ovary, cervix, uterus, testes, bladder, prostate, thyroid and lung cancer tumors. In particular examples, the sample is a tissue sample from a cancer that is a late-stage cancer, a metastatic cancer, undifferentiated cancer, ovarian cancer, in situ carcinoma (ISC), squamous cell carcinoma (SCC), prostate cancer, pancreatic cancer, non-small cell lung cancer, breast cancer, colon cancer.

In some aspects, when the tumor is a solid tumor, isolation of tumor cells can be achieved by surgical biopsy. Biopsy techniques that can be used to harvest tumor cells from a subject include, but are not limited to, needle biopsy, CT-guided needle biopsy, aspiration biopsy, endoscopic biopsy, bronchoscopic biopsy, bronchial lavage, incisional biopsy, excisional biopsy, punch biopsy, shave biopsy, skin biopsy, bone marrow biopsy, and the Loop Electrosurgical Excision Procedure (LEEP). Typically, a non-necrotic, sterile biopsy or specimen is obtained that is greater than 100 mg, but which can be smaller, such as less than 100 mg, 50 mg or less, 10 mg or less or 5 mg or less; or larger, such as more than 100 mg, 200 mg or more, or 500 mg or more, 1 gm or more, 2 gm or more, 3 gm or more, 4 gm or more or 5 gm or more. The sample size to be extracted for the assay can depend on a number of factors including, but not limited to, the number of assays to be performed, the health of the tissue sample, the type of cancer, and the condition of the subject. The tumor tissue is placed in a sterile vessel, such as a sterile tube or culture plate, and can be optionally immersed in an appropriate medium.

In some embodiments, tissue obtained from the patient after biopsy is fixed, such as by formalin (formaldehyde) or glutaraldehyde, for example, or by alcohol immersion. For histochemical methods, the tumor sample can be processed using known techniques, such as dehydration and embedding the tumor tissue in a paraffin wax or other solid supports known to those of skill in the art (see Plenat et ah, (2001) Ann Pathol. January 21(1):29-47), slicing the tissue into sections suitable for staining, and processing the sections for staining according to the histochemical staining method selected, including removal of solid supports for embedding by organic solvents, for example, and rehydration of preserved tissue.

In some embodiments, histochemistry methods are employed. In some cases, the binding reagent is directly attached or linked to a detectable label or other moiety for direct or indirect detection. Exemplary detectable regents including, but are not limited to, biotin, a fluorescent protein, bioluminescent protein or enzyme. In other examples, the binding reagents are conjugated, e.g. fused, to peptides or proteins that can be detected via a labeled binding partner or antibody. In some examples, a binding partner can be detected by HC methods using a labeled secondary reagent, such as labeled antibodies, that recognize one or more regions, e.g. epitopes, of the binding reagent.

In some embodiments, the resulting stained specimens, such as obtained by histochemistry methods, are each imaged using a system for viewing the detectable signal and acquiring an image, such as a digital image of the staining. Methods for image acquisition are well known to one of skill in the art. For example, once the sample has been stained, any optical or non-optical imaging device can be used to detect the stain or biomarker label, such as, for example, upright or inverted optical microscopes, scanning confocal microscopes, cameras, scanning or tunneling electron microscopes, canning probe microscopes and imaging infra-red detectors. In some examples, the image can be captured digitally. The obtained images can then be used for quantitatively or semi-quantitatively determining the amount of a binding partner, e.g. PD-L1, in the sample. Various automated sample processing, scanning and analysis systems suitable for use with immunohistochemistry are available in the art. Such systems can include automated staining and microscopic scanning, computerized image analysis, serial section comparison (to control for variation in the orientation and size of a sample), digital report generation, and archiving and tracking of samples (such as slides on which tissue sections are placed). Cellular imaging systems are commercially available that combine conventional light microscopes with digital image processing systems to perform quantitative analysis on cells and tissues, including immunostained samples. See, e.g., the CAS-200 system (Becton, Dickinson & Co.). In particular, detection can be made manually or by image processing techniques involving computer processors and software. Using such software, for example, the images can be configured, calibrated, standardized and/or validated based on factors including, for example, stain quality or stain intensity, using procedures known to one of skill in the art (see e.g. published U.S. patent Appl. No. US20100136549).

In some embodiments, a biological sample is detected for cells surface positive for a binding partner, e.g. PD-L1 and/or CD28, if there is a detectable expression level of the binding partner (e.g. following contacting with the binding reagent and detection of bound binding reagent) in at least or at least about or about 1% of the cells, at least or at least about or about 5% of the cells, at least or at least about or about 10% of the cells, at least or at least about or about 20% of the cells, at least or at least about or about 40% of the cells or more.

In some embodiments, the biological sample is a tumor tissue sample comprising stromal cells, tumor cells or tumor infiltrating cells, such as tumor infiltrating immune cells, e.g. tumor infiltrating lymphocytes. In some embodiments, the tumor tissue sample is detected for cells surface positive for PD-L1 if there is a detectable expression level of the binding partner (e.g. following contacting with the binding reagent and detection of bound binding reagent) in at least or at least about or about 1% of the cells, at least or at least about or about 5% of the cells, at least or at least about or about 10% of the cells, at least or at least about or about 20% of the cells, at least or at least about or about 40% of the cells or more. In some embodiments, the cells are tumor cells or tumor infiltrating immune cells. In some embodiments, the tumor tissue sample is detected for cells surface positive for CD28 if there is a detectable expression level of the binding partner (e.g. following contacting with the binding reagent and detection of bound binding reagent) in at least or at least about or about 1% of the cells, at least or at least about or about 5% of the cells, at least or at least about or about 10% of the cells, at least or at least about or about 20% of the cells, at least or at least about or about 40% of the cells or more. In some embodiments, the cells are tumor infiltrating immune lymphocytes.

VIII. EXEMPLARY EMBODIMENTS

Among the provided embodiments are:

1. A variant PD-1 polypeptide, comprising an IgV domain or a specific binding fragment thereof, wherein the variant PD-1 polypeptide comprises one or more amino acid modifications in a position(s) of an unmodified PD-1 polypeptide or a specific binding fragment thereof corresponding to position(s) selected from 8, 9, 11, 12, 14, 16, 18, 20, 21, 22, 23, 24, 28, 31, 33, 34, 35, 36, 37, 40, 41, 42, 43, 51, 52, 59, 64, 66, 75, 80, 81, 85, 86, 89, 90, 91, 93, 94, 100, 106, 113, 114, 116, 129, 130, 132, 133, 134, 135, 136, 137, 138, 139, 140, 141, 142, 143 or 144 with reference to numbering of positions set forth in SEQ ID NO:37.

2. The variant PD-1 polypeptide of embodiment 1, wherein the one or more amino acid modifications are selected from an amino acid substitution P8T, D9E, D9G, D9N, D9V, P11A, W12G, W12L, W12R, P14H, P14L, P14S, T16A, T16I, T16S, S18T, A20S, A20T, A20V, L21V, L22I, V23E, V23G, V24L, D28E, T31I, T31N, T31S, T33I, C34Y, S35N, F36I, F36L, F36Y, S37P, S37T, S40P, S40T, E41D, E41V, S42G, S42R, F43L, F43Y, S51G, P52A, P52L, L59M, L59R, L59V, E64D, E64K, R66H, R66S, F75Y, L80Q, P81S, R84H, R84Q, D85G, D85N, F86Y, S89G, S89N, V90L, V90M, V91A, V91D, V91I, A93V, R94Q, T100A, T100I, T100S, I106L, Q113R, Q113W, I114T, E116D, A129S, E130K, P132H, P132R, P132S, P132T, T133A, T133R, T133S, A134D, A134V, H135N, H135R, H135Y, P136L, P136T, S137C, P138S, P138T, S139T, P140A, P140L, P140R, R141G, R141M, R141S, R141W, P142A, P142L, P142R, P142T, A143D, A143S, A143V, G144D, or G144S, or a conservative amino acid substitution thereof.

3. The variant PD-1 polypeptide of embodiment 1 or embodiment 2, wherein at least one amino acid modification is at a position selected from 12, 40, 59, 86, 93, 133, 141 or 143.

4. A variant PD-1 polypeptide, comprising an IgV domain or a specific binding fragment thereof, wherein the variant PD-1 polypeptide comprises one or more amino acid modifications in an unmodified PD-1 polypeptide or a specific binding fragment thereof corresponding to amino acid modification(s) selected from an amino acid substitution P8T, D9E, D9G, D9N, D9V, P11A, W12G, W12L, W12R, N13Y, P14H, P14L, P14S, T16A, T16I, T16S, F17I, F17V, F17Y, S18T, A20S, A20T, A20V, L21V, L22I, V23E, V23G, V24L, D28E, N29D, I31I, T31N, T31S, I33I, C34Y, S35N, F36I, F36L, F36Y, S37P, S37T, N38S, N38T, I39R, T39S, S40P, S40T, E41D, E41V, S42G, S42R, F43L, F43Y, V44M, Y48N, M50T, S51G, P52A, P52L, S53T, N54H, Q55R, T56M, T56P, T56S, K58R, L59M, L59R, L59V, E64D, E64K, R66H, R66S, S67C, S67I, S67N, S67R, P69H, G70C, G70E, G70S, Q71H, Q71K, Q71L, D72N, C73A, C73G, C73H, C73P, C73Y, F75Y, R76H, R76S, V77D, T78S, Q79P, L80Q, P81S, R84H, R84Q, D85G, D85N, F86Y, H87P, S89G, S89N, V90L, V90M, V91A, V91D, V91I, R92N, R92S, A93V, R94Q, R95L, N96T, T100A, T100I, T100S, L102F, G104A, G104T, G104V, A105C, A105G, A105L, I106L, L108T, A109G, K111M, K111N, Q113R, Q113W, I114T, K115D, K115E, K115IN, K115N, K115Q, E116D, R119H, R119L, R119P, R119Q, R119W, T125K, T125S, R127S, R128M, A129S, E130K, V131A, V131E, P132H, P132R, P132S, P132T, T133A, T133R, T133S, A134D, A134V, H135N, H135R, H135Y, P136L, P136T, S137C, P138S, P138T, S139T, P140A, P140L, P140R, R141G, R141M, R141S, R141W, P142A, P142L, P142R, P142T, A143D, A143S, A143V, G144D, or G144S, or a conservative amino acid substitution thereof with reference to numbering of positions set forth in SEQ ID NO:37.

5. The variant PD-1 polypeptide of any of embodiments 1-4, wherein at least one amino acid modification is W12G, W12L or W12R.

6. The variant PD-1 polypeptide of any of embodiments 1-4, wherein at least one amino acid modification is S40P or S40T.

7. The variant PD-1 polypeptide of any of embodiments 1-4, wherein at least one amino acid modification is L59R or L59V.

8. The variant PD-1 polypeptide of any of embodiments 1-4, wherein at least one amino acid modification is F86Y.

9. The variant PD-1 polypeptide of any of embodiments 1-4, wherein at least one amino acid modification is A93V.

10. The variant PD-1 polypeptide of any of embodiments 1-4, wherein at least one amino acid modification is T133A, T133R or T133S.

11. The variant PD-1 polypeptide of any of embodiments 1-4, wherein at least one amino acid modification is A143D, A143S or A143V.

12. The variant PD-1 polypeptide of embodiment 4, wherein at least one amino acid modification is F17I, F17V or F17Y.

13. The variant PD-1 polypeptide of embodiment 4, wherein at least one amino acid modification is T56M, T56P or T56S.

14. The variant PD-1 polypeptide of embodiment 4, wherein at least one amino acid modification is S67C, S67I, S67N or S67R.

15. The variant PD-1 polypeptide of any of embodiments 1-4, 8 and 14, comprising the amino acid modifications S67N and F86Y.

16. The variant PD-1 polypeptide of embodiment 4, wherein at least one amino acid modification is R95L.

17. The variant PD-1 polypeptide of embodiment 4, wherein at least one amino acid modification is G104A or G104V.

18. The variant PD-1 polypeptide of embodiment 4, wherein at least one amino acid modification is K111M or K111N.

19. The variant PD-1 polypeptide of embodiment 4, wherein at least one amino acid modification is K115D, K115E, K115IN, K115N or K115Q.

20. The variant PD-1 polypeptide of embodiment 4, wherein at least one amino acid modification is R119H, R119L, R119P, R119Q or R119W.

21. The variant PD-1 polypeptide of any of embodiments 1-20, comprising one or more further amino acid modifications in a position(s) corresponding to position(s) 73, 86, 107, 112, 115, 119 or 120, with reference to numbering of positions set forth in SEQ ID NO:37.

22. The variant PD-1 polypeptide of embodiment 21, wherein the one or more further amino acid modifications is selected from C73A, C73G, C73H, C73P, C73R, C73S, C73Y, F86Y, S107T, A112I, A112V, K115D, K115E, K115I, K115N, K115Q, R119H, R119L, R119P, R119Q, R119W or A120V.

23. The variant PD-1 polypeptide of any of embodiments 1-20, comprising one or more further amino acid modifications selected from N13D, N13S, N13Y, F17I, F17L, F17V, F17Y, T25A, N29D, A30V, N38D, N38S, N38T, T39R, T39S, V44H, V44M, L45V, N46I, Y48F, Y48H, Y48N, L45E, L45I, L45L, L45T, L45V, N46I, Y48F, Y48H, M50E, M50I, M50L, M50V, S53G, S53N, S53T, N54D, N54G, N54H, N54S, N54Y, Q55R, T56A, T56M, T56P, T56S, T56V, D57V, D57Y, K58R, K58T, S67C, S67G, S67I, S67N, S67R, Q68P, Q68R, P69H, P69L, P69S, G70C, G70E, G70R, G70S, G70V, Q71H, Q71K, Q71L, Q71R, D72G, D72N, C73A, C73G, C73H, C73P, C73R, C73S, C73Y, R76H, R76S, V77D, T78S, Q79P, Q79R, H87L, H87R, R92G, R92N, R92S, R95L, N96D, N96S, N96T, L102F, L102V, G104A, G104S, G104V, A105C, A105G, A105L, A105V, S107T, L108F, L108T, A109G, K111E, K111M, K111N, K111R, K111T, A112I, A112V, K115D, K115E, K115I, K115N, K115Q, R119H, R119L, R119P, R119Q, R119W, A120V, T125I, T125K, T125S, R127S, R128M, V131A, or V131E, or a conservative amino acid substitution thereof.

24. The variant PD-1 polypeptide of any of embodiments 1-20 and 23, comprising one or more further amino acid modifications selected from N13D, N13S, F17L, T25A, A30V, N38D, V44H, L45V, N46I, Y48F, Y48H, M50E, M50I, M50L, M50V, S53G, S53N, N54D, N54G, N54S, N54Y, T56A, T56V, D57V, D57Y, K58T, S67G, Q68P, Q68R, P69L, P69S, G70R, G70V, Q71R, D72G, C73S, C73R, Q79R, H87R, R92G, N96D, N96S, L102V, G104S, A105V, S107T, L108F, K111E, K111R, K111T, A120V or T125I.

25. The variant PD-1 polypeptide of embodiment 23 or embodiment 24, wherein the one or more further amino acid modification comprises at least one further amino acid modification that is M50E, M50I, M50L or M50V.

26. The variant PD-1 polypeptide of embodiment 23 or embodiment 24, wherein the one or more further amino acid modification comprises at least one further amino acid modification that is P69L or P69S.

27. The variant PD-1 polypeptide of any of embodiments 22-24, wherein the one or more further amino acid modification comprises at least one further amino acid modification that is C73R or C73S.

28. The variant PD-1 polypeptide of embodiment 27, comprising the amino acid modifications S67N/C73R, S67N/C73S, C73R/F86Y, C73S/F86Y, C73R/R119L, C73S/R119L, C73R/R119W or C73S/R119W.

29. The variant PD-1 polypeptide of embodiment 23 or embodiment 24, wherein the one or more further amino acid modification comprises at least one further amino acid modification that is R92G.

30. The variant PD-1 polypeptide of any of embodiments 22-24, wherein the one or more further amino acid modification comprises at least one further amino acid modification that is S107T.

31. The variant PD-1 polypeptide of any of embodiments 22-24, wherein the one or more further amino acid modification comprises at least one further amino acid modification that is A112I or A112V.

32. The variant PD-1 polypeptide of embodiment 31, wherein the amino acid modifications comprise S67N/A112I, S67N/A112V, F86Y/A112I, F86Y/A112V, A112I/R119L, A112V/R119L, A112I/R119W or A112V/R119W.

33. The variant PD-1 polypeptide of any of embodiments 22-24, wherein the one or more further amino acid modification comprises at least one further amino acid modification that is A120V.

34. The variant PD-1 polypeptide of embodiment 33, wherein the amino acid modifications comprise S67N/A120V, F86Y/A120V, R119L/A120V or R119W/A120V.

35. The variant PD-1 polypeptide of embodiment 23 or embodiment 24, wherein the one or more further amino acid modification comprises at least one further amino acid modification that is T125I.

36. The variant PD-1 polypeptide of any of embodiments 1-35, wherein the variant PD-1 polypeptide comprises up to 1, 2, 3, 4, 5, 6, 7, 8, 9, 10, 11, 12, 13, 14, 15, 16, 17, 18, 19 or 20 amino acid modification, optionally wherein the amino acid modification is an amino acid substitution.

37. A variant PD-1 polypeptide, comprising an IgV domain or a specific binding fragment thereof, wherein the variant PD-1 polypeptide comprises two or more amino acid modification in an unmodified PD-1 polypeptide or a specific binding fragment thereof corresponding to amino acid modification(s) selected from C73A, C73G, C73H, C73P, C73R, C73S, C73Y, F86Y, S107T, A112V, K115D, K115E, K115I, K115N, K115Q, R119H, R119L, R119P, R119Q, R119W or A120V, with reference to numbering of positions set forth in SEQ ID NO:37.

38. The variant PD-1 polypeptide of embodiment 37, wherein the two or more amino acid modifications in an unmodified PD-1 polypeptide or a specific binding fragment thereof corresponds to amino acid modification(s) C73A/F86Y, C73G/F86Y, C73H/F86Y, C73P/F86Y, C73R/F86Y, C73S/F86Y, C73Y/F86Y, F86Y/K115D, F86Y/K115E, F86Y/K115I, F86Y/K115N, F86Y/K115Q, F86Y/R119H, F86Y/R119L, F86Y/R119P, F86Y/R119Q, F86Y/R119W, C73A/S107T, C73G/S107T, C73H/S107T, C73P/S107T, C73R/S107T, C73S/S107T, C73Y/S107T, S107T/K115D, S107T/K115E, S107T/K115I, S107T/K115N, S107T/K115Q, S107T/R119H, S107T/R119L, S107T/R119P, S107T/R119Q, S107T/R119W, C73A/A112V, C73G/A112V, C73H/A112V, C73P/A112V, C73R/A112V, C73S/A112V, C73Y/A112V, A112V/K115D, A112V/K115E, A112V/K115I, A112V/K115N, A112V/K115Q, A112V/R119H, A112V/R119L, A112V/R119P, A112V/R119Q, A112V/R119W, C73A/A120V, C73G/A120V, C73H/A120V, C73P/A120V, C73R/A120V, C73S/A120V, C73Y/A120V, K115D/A120V, K115E/A120V, K115I/A120V, K115N/A120V, K115Q/A120V, R119H/A120V, R119L/A120V, R119P/A120V, R119Q/A120V, R119W/A120V, F86Y/S107T, F86Y/A112V, F86Y/A120V, S107T/A112V, S107T/A120V or A112V/A120V.

39. The variant PD-1 polypeptide of any of embodiments 1-38, wherein the variant PD-1 polypeptide comprises 2, 3, 4, 5, 6, 7, 8, 9, 10, 11, 12, 13, 14, 15, 16, 17, 18, 19 or 20 amino acid modifications, optionally wherein the amino acid modifications are amino acid substitutions.

40. The variant PD-1 polypeptide of any of embodiments 1-39, comprising:
  replacement of a cysteine residue at a position corresponding to position 73 to another amino acid, wherein the replacement is to an amino acid residue selected from Ala (A), Arg (R) or Ser (S); and/or
  replacement of the amino acid residue at a position corresponding to position 59 or 60 with a cysteine,
  wherein numbering is with reference to positions set forth in SEQ ID NO:37.

41. The variant PD-1 polypeptide of any of embodiments 1-40, wherein the variant PD-1 polypeptide comprises one or more amino acid modifications in an unmodified PD-1 polypeptide or a specific binding fragment thereof corresponding to amino acid modification(s) selected from A112V/R119L/A120V; N13S/A120V/P142A; C34Y/N54D/T100S/A112V/A120V; M50V/S67N/L80Q/A120V/A143S; A112V/R119W; R84H/H87L/A112V/R119W; Q71R/V91I/A112V/R119L/A120V/T125S; A112V/K115E; M50L/L59V/R66H/A112V/H135Y/P138T/P142L; R119W; S53G/Q55R/A112V/K115E/A120V/S139T; R119W/H135R; A120V/T125I; A112V/A120V/V131A; F17I/K111E/A112V/A120V; S18T/R119Q/R141M; F36L/S37T/A112V/H135N/P138S; A112V/T125I; M50I/A112V/A120V; S67N/C73R/A93V/A112V/A120V; D72G/A112V/A120V; N96D/A112V/A120V/T125S; F86Y/R119W/T125I; R119P/T133R; K111M/A112V/K115E/P132H; S67G/A112V/T125I/T133S; A112V/A120V; S37P/A112V/R119W; W12L/S37P/A112V/R119W; D9G/A112V/A120V; T31S/S37T/A112V/T125I/A143S; S37T/A112V/T125I; R92G/A112V/A120V; E64D/F86Y/A112V/A120V; H87R/A112V/R119W; N13D/A105V/A112V/A120V/A134D; A112V/R119L/A120V/S137C; T16I/M50I/A112V/A120V; M50L/A112V/R119Q/A120V/T125I/H135R; D57V/A112V; S67N/R119W; S67N/A112V/A120V; N54Y/A112V/P140A; F43Y/P69L/R119W; N54Y/A112V/R119W; T56M/C73S/R76H/A112V/R119L/A120V/P132T/R141W; F17I/S40P/E41D/S67N/R95L/A112V/A120V/T125I/R141M; F17L/T31S/S35N/P81S/N96S/A112V/R119W; F43L/S67N/C73R/A112V/A120V; W12L/N38D/A112V/R119Q/A120V/P142T; S67N/P69H/C73R/Q79P/V91D/A112V/A120V/P136T/A143D; F17I/S40P/S67N/Q79R/A112V/R119W/T125I; F43Y/M50V/S67N/C73R/R92G/A112V/A120V/P136T; F17L/T56M/S67N/A112V/R119W/A120V/P142R; W12L/N54Y/S67N/F75Y/V91D/R95L/G104A/A112V/R119W/R141M; F17L/S37T/S67N/T78S/F86Y/A112V/R119H/A120V/V131E/A143V; N13D/S40P/A112V/R119L/A120V/S137C; F17V/A30V/E41V/R76S/A112V/R119Q/A120V/V131A; F17I/T25A/M50V/S53T/R66S/S67R/S107T/A112V/R119W/A143V; N13D/S40P/S67N/C73R/R95L/G104A/A112V/A120V; S40P/T56A/S67N/C73R/A112V/R119Q/A120V/V131A; N13Y/S40P/F43L/Q68P/R92G/A112V/R119L/A120V; F17L/S67N/Q71L/C73S/A112V/R119Q/A120V/P142L; F17I/S40P/P69S/C73S/N96S/G104A/A112V/A120V; F17I/

S40P/A112V/R119L/A120V/P140R; A112V/A120V/ T133S; A20S/S67N/C73R/R94Q/A112V/R119Q/A120V/ T125I/P132S; N13D/S67N/C73R/R95L/A112V/R119Q/ A120V/T125I; S40P/S67N/C73R/N96T/A112V/A120V; L21V/S40P/R95L/G104A/A112V/A120V/A129S/V131A/ R141G; P14S/S40P/S42R/P52A/T56M/A112V/R119W/ T125I/P142A; S40P/F43L/T56A/S67N/C73S/A112V/ R119L/A120V; F17I/S40P/M50V/S67N/C73S/R95L/ G104A/A112V/R119L/A120V; S40P/T56M/C73S/R95L/ A112V/R119W/T125I/V131A/R141W; F17I/A20V/S51G/ N54D/F86Y/A112V/A120V/T125I; F17I/T31N/T56M/ S67N/C73R/G104A/A112V/R119Q/A120V/T133A/P140L; F17V/S40P/R92G/R95L/A112V/R119W; W12G/F17L/ T56V/S67N/A112V/R119W/V131E/R141S; F86Y/R92G/ A112V/R119L/A120V/T125K/T133S; P8T/F17I/S67N/ F86Y/G104A/A112V/A120V/S139T; F17I/S40P/A112V/ R119W/G144D L22I/S67I/G70S/Q71R/S107T/A112V/R119L/A120V/T125I/T133S; S40P/A112V/A120V; T16S/S67N/C73R/A112V/R119W; N13D/S40P/A112V/A120V/T125I/T133S; M50L/V91D/A112V/R119W/P132R/R141G; F17I/S40P/M50I/S67R/A112V/R119L/A120V/S137C; S40P/A112V/R119W; F17I/V24L/A112V/R119W; S40P/S67N/C73R/A93V/A112V/A120V; N13D/F17I/A112V/R119W/R141M; S67N/C73R/A112V/A120V/R141S; W12R/L59V/R66H/F86Y/V90L/A112V/K115N/R119L/A120V; F36L/M50I/S51G/C73R/S107T/K111M/A120V/V131E; M50V/R119W/A120V/T125I/R141G; A109G/A112V/K115E/R119W; Q55R/R76H/A112V/K115I/A120V; W12R/F86Y/R95L/A112V/R119P/T133R; S67N/C73Y/A112V; F17I/S40P/T56S/A112V; W12L/P14S/M50V/S67R/A93V/R94Q/K111T/A112V/R119W/A120V; F36L/L59R/S67N/A105L/A112V/R119W/A120V/A143V; L59M/E64K/F86Y/R94Q/A112V/R119L/A120V/T125I/T133S; P14H/F17Y/T39R/S40T/K58R/V77D/G104V/A112V/Q113R/I114T/A143V; D57V/L59M/P69S/C73S/A112V/R119L/A120V/A134V; V23E/T39S/S40P/C73Y/V91A/R92N/L102F/A112V/R119W/A120V; T16A/F17I/F36L/S67N/C73R/H87L/R92G/R95L/A112V/R119W; C73S/A105V/A112V/R119W/A120V/T133A; P14S/M50L/L59V/R66H/G70S/C73R/A112V/A120V/T125I/G144S; P8T/S40P/S53N/R95L/A112V/A120V/T125I/R128M/P138T/R141G; S37T/T56M/C73S/D85N/A109G/A112V/A120V/H135Y/A143S; S67N/C73R/A93V/G104A/A112V/R119Q/R127S/H135R; S40P/S67N/C73R/A112V/A120V; S67N/C73R/A93V/A112V/R119W; C73R/A93V/A112V/R119W; S67N/C73R/A112V/A120V; N13D/P69H/C73R/A93V/A112V/R119W/R141S; F17I/N38D/S40P/S67N/C73R/A112V/A120V; N13D/F17I/S40P/T56M/R66S/S67N/G70C/A112V/A120V/R141S; S40P/F43L/R66S/S67N/G70C/A112V/R119L/A120V; V23G/S40T/G104A/A112V/R119L/A120V; W12R/F36I/N54Y/S67I/C73S/A93V/G104A/A112V/K115Q/R119W; S40P/M50L/S67I/C73S/R92G/A93V/A112V/A120V/R141S; F17I/T25A/S40P/F43Y/S67N/C73R/F86Y/A112V/R119W/T125I; F17I/S40P/M50L/S67I/C73S/A112V/A120V/E130K/P136L; W12R/S40P/S67N/C73R/A93V/A112V/A120V/R141S; F17I/S40P/M50L/S67I/C73S/R92G/A93V/A112V/A120V/R141S; F17I/S40P/M50L/S67I/A112V/A120V/R141S; V23G/T56P/S67I/C73S/F86Y/R92G/G104A/A112V/R119W/A143D; F17I/S40P/M50L/S67I/C73S/R92G/A93V/A112V/R119W/T125I; D9V/P11A/N13D/S40T/T56M/S67N/R95L/G104A/A112V/R119L/A120V; F17I/T25A/S40P/F43Y/S67N/A112V/R119L/A120V; D9E/F17I/S40P/M50L/S67I/C73S/V90M/T100A/G104A/K111M/A112V/R119W/A120V/A143D; F17I/S40P/M50L/S67I/C73S/R92G/A93V/A112V/A120V/R141G; F17I/S40P/S67N/S89G/R95L/A112V/R119W/T125I; F17I/S40P/M50L/S67I/C73S/R92G/A93V/K111M/A112V/R119Q/A120V; D9N/F17I/T31N/S40P/M50L/S67I/C73S/R92G/A93V/A112V/A120V/R141S; N13D/S40T/T56M/S67N/R95L/G104A/K111R/A112V/A120V/T125I; W12G/F17I/S40P/M50L/A112V/P132T; D9N/F17I/S40P/M50T/T56A/G70S/C73R/R92G/A93V/A112V/A120V/R141S; N38S/L59M/Q71L/S107T/A112V/K115E/R119Q/A120V; M50V/L59M/A112V/R119Q/A120V P81S/F86Y/R92S/S107T/A112V/K115E/A120V; C73R/R84Q/F86Y/S107T/A112V/K115D/A120V; W12G/M50T/S53N/S67R/G70S/C73R/G104V/A112V/K115E/R119W; T31I/F36Y/F43Y/S67N/G70S/C73R/V90M/A112V/R119W; R76S/S107T/K111N/A112V/K115N/A120V; F86Y/A112V/R119W/A120V; N13S/M50I/R76S/S107T/A112V/K115N/R119W/A120V; P14H/T16S/M50L/C73R/R84Q/F86Y/S107T/A112V/K115E/A120V; F17L/T25A/L59M/E64K/F86Y/R94Q/S107T/A112V/K115N/R119W/A120V; Q71R/F86Y/A112V/K115E/R119Q/A120V; R76S/S107T/A112V/K115N/R119W/A120V; M50I/A112V/K115D/A120V; M50V/P81S/F86Y/R92S/S107T/A112V/K115E/A120V; M50I/S67N/G70R/K111T/A112V/R119W/A120V; P14H/T16S/M50L/L80Q/K111M/R119Q/A120V; T31I/F36Y/E64K/A112V/K115E/R119Q/A120V; S107T/A112V/R119W/A120V; T56S/A112V/K115E/A120V; T56S/A112V/R119W; N46I/Y48N/D57Y/S67C/V90L/A112V; T56S/A112V/R119P; P14H/F17I/V44M/A112V/K115E/A120V; N38S/T56S/A112V/K115E/A120V; S42G/M50L/P69S/F86Y/A112V/K115E; P14H/T56S/A112V/K115E/A120V; N13S/S67N/G70C/F86Y/S89N/V91D/A112V/R119L/A120V; W12G/S67N/Q71R/F86Y/K111M/A112V/K115Q/R119W; S67N/C73R/V91D/S107T/K111M/A112V/K115Q/R119W; N13S/M50I/R76S/S107T/K111M/A112V/K115Q/R119W; T33I/S67N/G70S/S107T/K111N/A112V/K115E/R119W; P69L/F86Y/V90M/T100I/S107T/K111N/A112V/K115N/A120V; F17L/T25A/P69L/F86Y/V90M/T100I/S107T/K111N/A112V/K115N/A120V; T33I/M50I/R76S/F86Y/S107T/A112V/K115N/R119W/A120V; N13S/S67N/C73R/F86Y/S107T/A112V/Q113R/K115E/A120V; S67N/C73R/F86Y/V91D/S107T/A112V/K115D/A120V; F17L/T25A/S67N/C73R/R84Q/F86Y/A93V/A112V/K115E/R119W; T56S/A112V/K115E P69L/V91D/A112V/K115N/R119W/A120V; N13S/E41D/M50I/G70V/D72N/F86Y/R94Q/A112V/R119L/A120V; M50I/P69L/F86Y/V90M/T100I/S107T/K111N/A112V/K115N/A120V; M50I/C73R/S107T/K111N/A112V/K115N/A120V; F86Y/A112V/K115N/R119W; M50I/S67N/C73R/F86Y/R95L/S107T/A112V/K115N/R119W; M50L/Q68R/P69S/F86Y/S107T/A112V/K115N/R119W; N38T/A112V/K115N/R119L/A120V; S67N/Q71H/F86Y/R95L/S107T/A112V/K115N/R119W; A20T/D28E/F36L/M50I/Q68R/P69S/F86Y/A112V/R119L/A120V; M50I/S67N/C73R/F86Y/R95L/A112V/Q113W/R119L/A120V; L59M/S67N/Q71L/C73R/R95L/S107T/A112V/K115N/R119W; P52L/S53N/C73S/A112V/E116D/R119W; Q71R/C73R/A112V/K115N/R119L/A120V; W12L/A20T/N29D/S37P/L59M/Q68R/P69S/F86Y/A112V/R119L/A120V; N46I/Y48F/D57V/P69L/A112V/K115N/R119W; M50I/S67N/C73R/F86Y/R95L/S107T/A112V/K115Q/R119Q/A120V; N54D/P69H/C73R/F86Y/R95L/S107T/A112V/K115N/R119W; T56S/Q71K/F86Y/R95L/S107T/A112V/K115N/R119W; C73A/F86Y/S107T/A112V/K115N/R119Q/A120V; C73R/F86Y/A105G/S107T/A112V/K115N/R119L/A120V; N54H/G70E/C73P/F86Y/A112V/K115D/R119L/A120V; C73G/F86Y/S107T/A112V/K115N/R119Q/A120V; N54S/C73G/F86Y/S107T/A112V/K115D/R119L/A120V; F86Y/S107T/A112V/K115D/R119W/A120V; G70E/C73P/F86Y/S107T/A112V/K115E/R119Q/A120V; C73G/F86Y/A105G/

S107T/A112V/K115D/R119W; C73G/F86Y/S107T/A112V/K115D/R119L/A120V; C73S/F86Y/S107T/A112V/K115D/R119L/A120V; L45V/C73G/F86Y/G104A/S107T/A112V/K115N/R119W/A120V; C73P/F86Y/S107T/A112V/K115D/R119Q/A120V; C73S/F86Y/S107T/A112V/K115E/R119Q/A120V; C73S/F86Y/G104T/S107T/A112V/K115E/R119W/A120V; C73R/F86Y/S107T/K111R/A112V/K115D/A120V; P14L/C73G/F86Y/S107T/A112V/K115D/R119L/A120V; G70E/F86Y/S107T/A112V/K115D/R119L/A120V; C73G/F86Y/G104V/S107T/A112V/K115N/R119L/A120V; C73S/F86Y/G104S/S107T/L108F/A112V/K115D/R119L/A120V; C73S/F86Y/S107T/A112V/K115D/A120V; C73R/F86Y/S107T/A112V/K115D/R119L/A120V; C73S/F86Y/S107T/A112V/Q113R/K115D/R119L/A120V; C73S/F86Y/V91A/S107T/A112V/K115D/R119L/A120V; G70E/C73P/F86Y/A105G/S107T/A112V/K115D/R119Q/A120V; C73G/F86Y/A105G/S107T/A112V/K115D/R119L/A120V; C73G/F86Y/A105G/S107T/A112V/Q113R/K115D/R119L/A120V; F86Y/S107T/A112V/K115D/R119Q/A120V; C73R/F86Y/S107T/A112V/K115N/R119L/A120V; C73A/F86Y/S107T/A112V/Q113R/K115E/R119Q/A120V; C73R/F86Y/S107T/A112V/K115D/R119Q/A120V; C73G/F86Y/A112V/K115D/R119W/A120V; C73P/F86Y/A105G/S107T/A112V/Q113R/K115D/R119L/A120V; C73R/F86Y/A105G/S107T/A112V/K115D/R119L/A120V; C73A/F86Y/S107T/A112V/K115D/R119L/A120V; P69S/C73R/F86Y/S107T/A112V/K115D/R119W/A120V; C73S/F86Y/G104S/S107T/A112V/K115E/R119W/A120V; Q68R/C73S/F86Y/S107T/A112V/K115D/R119Q/A120V; C73R/F86Y/S107T/A112V/K115N/R119Q/A120V; G70E/C73R/F86Y/S107T/A112V/K115N/R119Q/A120V; C73S/F86Y/S107T/A112V/K115D/R119W/A120V; G70E/F86Y/G104T/I106L/S107T/L108T/A112V/K115N/R119L/A120V; C73H/F86Y/A105G/S107T/A112V/K115D/R119L/A120V; G70E/C73P/F86Y/A105C/S107T/A112V/K115D/R119L/A120V; G70E/C73P/F86Y/S107T/A112V/K115D/R119Q/A120V; C73S/F86Y/S107T/K111R/A112V/K115E/R119L/A120V; C73R/D85G/F86Y/A105G/S107T/A112V/K115D/R119Q/A120V; C73R/F86Y/S107T/A112V/K115E/R119W/A120V; N54S/C73G/F86Y/S107T/A112V/K115E/R119Q/A120V; C73S/F86Y/G104S/S107T/A112V/K115N/R119L/A120V; F17L/Q71R/C73G/F86Y/A105G/S107T/A112V/K115D/R119L/A120V; C73G/F86Y/S107T/A112V/K115E/R119W/A120V; G70E/C73G/F86Y/A105C/S107T/A112V/K115E/R119L/A120V; C73G/F86Y/G104A/S107T/A112V/K115D/R119W/A120V; C73S/F86Y/S107T/A112V/K115N/A120V; C73P/F86Y/S107T/A112V/K115N/R119L/A120V; W12R/F86Y/S107T/A112V/K115D/R119Q/A120V; G70E/C73G/F86Y/A105L/A112V/K115N/R119Q/A120V; F86Y/S107T/A112V/K115N/R119W/A120V, with reference to numbering of positions set forth in SEQ ID NO:37.

42. The variant PD-1 polypeptide of any of embodiments 1-41, comprising the amino acid modifications S67N/C73R/F86YN91D/S107T/A112V/K115D/A120V.

43. The variant PD-1 polypeptide of any of embodiments 1-41, comprising the amino acid modifications P52L/S53N/C73S/A112V/E116D/R119W.

44. The variant PD-1 polypeptide of any of embodiments 1-41, comprising the amino acid modifications Q71R/C73R/A112V/K115N/R119L/A120V.

45. The variant PD-1 polypeptide of any of embodiments 1-44, wherein the variant PD-1 polypeptide is or comprises the IgV domain or a specific binding fragment thereof.

46. The variant PD-1 polypeptide of any of embodiments 1-45, wherein the unmodified PD-1 comprises (i) the sequence of amino acids set forth in SEQ ID NO:37, (ii) a sequence of amino acids that has at least 95% sequence identity to SEQ ID NO:37; or (iii) is a portion of (i) or (ii) comprising an IgV domain or specific binding fragment thereof.

47. The variant PD-1 polypeptide of any of embodiments 1-46, comprising the sequence of amino acids set forth in any of SEQ ID NOS: 103-243, 490-548, or 869-926 or a specific binding fragment thereof, or a sequence of amino acids that exhibits at least 95% sequence identity to any of SEQ ID NOS: 103-243, 490-548, or 869-926 or a specific binding fragment thereof and that contains the one or more of the amino acid modifications thereof.

48. The variant PD-1 polypeptide of any of embodiments 1-46, wherein the unmodified PD-1 comprises (i) the sequence of amino acids set forth in SEQ ID NO:392, (ii) a sequence of amino acids that has at least 95% sequence identity to SEQ ID NO:392; or (iii) is a portion of (i) or (ii) comprising an IgV domain or specific binding fragment thereof.

49. The variant PD-1 polypeptide of any of embodiments 1-46 and 48, comprising the sequence of amino acids set forth in any of SEQ ID NOS: 393-451, 647-780 or 811-868 or a specific binding fragment thereof, or a sequence of amino acids that exhibits at least 95% sequence identity to any of SEQ ID NOS: 393-451, 647-780 or 811-868 or a specific binding fragment thereof and that contains the one or more of the amino acid modifications thereof.

50. The variant PD-1 polypeptide of any of embodiments 1-46, wherein the unmodified PD-1 comprises (i) the sequence of amino acids set forth in SEQ ID NO: 244, (ii) a sequence of amino acids that has at least 95% sequence identity to SEQ ID NO:244; or (iii) is a portion of (i) or (ii) comprising an IgV domain or specific binding fragment thereof.

51. The variant PD-1 polypeptide of any of embodiments 1-46 and 50, comprising the sequence of amino acids set forth in any of SEQ ID NOS: 245-328, 549-606, 927-982 or a specific binding fragment thereof, or a sequence of amino acids that exhibits at least 95% sequence identity to any of SEQ ID NOS: 245-328, 549-606, 927-982 or a specific binding fragment thereof and that contains the one or more of the amino acid modifications thereof.

52. The variant PD-1 polypeptide of any of embodiments 1-51, wherein the extracellular domain or a portion thereof containing the IgV domain or specific binding fragment thereof is the only PD-1 portion of the variant PD-1 polypeptide.

53. The variant PD-1 polypeptide of any of embodiments 1-52, wherein the variant PD-1 exhibits increased binding to the ectodomain of human PD-L1 compared to the binding affinity of the unmodified PD-1 for the ectodomain of human PD-L1.

54. The variant PD-1 polypeptide of embodiment 53, wherein the binding affinity is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 60-fold, 80-fold, 100-fold, 150-fold, 200-fold, 250-fold, 300-fold, 400-fold, or 450-fold compared to binding affinity of the unmodified PD-1 for the ectodomain of PD-L1.

55. The variant PD-1 polypeptide of embodiment 53 or embodiment 54, wherein the PD-L1 is human PD-L1.

56. The variant PD-1 polypeptide of any of embodiments 53-55, wherein the binding affinity of the variant PD-1 polypeptide for the ectodomain of PD-L1 is greater than the binding affinity of the variant PD-1 polypeptide for the ectodomain of PD-L2 of the same species.

57. The variant PD-1 polypeptide of embodiment 56, wherein the binding affinity is at least or at least about 1.2-fold, 3-fold, 4-fold, 5-fold or more greater for PD-L1 than for PD-L2.

58. The variant PD-1 polypeptide of any of embodiments 1-57, wherein the variant PD-1 polypeptide exhibits a greater ratio of binding for the ectodomain of PD-L1 versus the ectodomain of PD-L2 compared to the ratio of binding of the unmodified or wild-type for PD-1 for the ecodomain of PD-L1 versus PD-L2.

59. The variant PD-1 polypeptide of embodiment 58, wherein the ratio is greater by at least or at least about 1.5-fold, 2.0-fold, 3.0-fold, 4.0-fold, 5-fold, 10-fold, I5-fold, 20-fold, 30-fold, 40-fold, 50-fold or more.

60. The variant PD-1 polypeptide of any of embodiments 53-59, wherein binding affinity is determined by Mean Fluorescence Intensity (MFI) as measured by flow cytometry.

61. The variant PD-1 polypeptide of any of embodiments 1-60, wherein:
the variant PD-1 polypeptide lacks the PD-1 transmembrane domain and intracellular signaling domain; and/or
the variant PD-1 polypeptide is not capable of being expressed on the surface of a cell.

62. The variant PD-1 polypeptide of any of embodiments 1-61 that is a soluble protein.

63. The variant PD-1 polypeptide of any of embodiments 1-62, wherein the variant PD-1 polypeptide is linked to a moiety that increases biological half-life of the polypeptide.

64. The variant PD-1 polypeptide of any of embodiments 1-63, wherein the variant PD-1 polypeptide is linked to a multimerization domain.

65. The variant PD-1 polypeptide of embodiment 64, wherein the multimerization domain is an Fc domain or is a variant Fc domain with reduced effector function.

66. The variant PD-1 polypeptide of any of embodiments 1-60 that is a transmembrane immunomodulatory protein, wherein the variant PD-1 polypeptide further comprises a transmembrane domain and/or a cytoplasmic signaling domain.

67. An immunomodulatory protein, comprising a first variant PD-1 polypeptide of any of embodiments 1-66 and a second variant PD-1 polypeptide of any of embodiments 1-66.

68. The immunomodulatory protein of embodiment 67, wherein the first and second variant PD-1 polypeptide are linked indirectly via a linker.

69. The immunomodulatory protein of embodiment 67 or embodiment 68, wherein the first and second variant PD-1 polypeptide are each linked to a multimerization domain, whereby the immunomodulatory protein is a multimer comprising the first and second variant PD-1 polypeptide.

70. The immunomodulatory protein of embodiment 69, wherein the multimer is a dimer, optionally a homodimer.

71. The immunomodulatory protein of any of embodiments 67-70, wherein the first variant PD-1 polypeptide and the second variant PD-1 polypeptide are the same.

72. An immunomodulatory protein, comprising a variant PD-1 polypeptide of any of embodiments 1-66 and a second polypeptide that is capable of specifically binding to CD28, optionally human CD28.

73. An immunomodulatory protein, comprising (1) a variant PD-1 polypeptide comprising an extracellular domain or a portion thereof containing the IgV domain or specific binding fragment thereof, wherein the variant PD-1 polypeptide exhibits increased binding affinity for the ectodomain of PD-L1 compared to the binding affinity of the unmodified PD-1 polypeptide for the ectodomain of PD-L1, and (2) a CD28-binding polypeptide that is capable of specifically binding to CD28, optionally human CD28.

74. The immunomodulatory protein of embodiment 73, wherein the binding affinity is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 60-fold, 80-fold, 100-fold, I50-fold, 200-fold, 250-fold, 300-fold, 400-fold, or 450-fold compared to binding affinity of the unmodified PD-1 for the ectodomain of PD-L1.

75. The immunomodulatory protein of embodiment 73 or embodiment 74, wherein the variant PD-1 polypeptide comprises one or more amino acid modifications in an unmodified PD-1 polypeptide or a specific binding fragment thereof corresponding to amino acid modification(s) selected from an amino acid substitution P8T, D9E, D9G, D9N, D9V, P11A, W12G, W12L, W12R, N13D, N13S, N13Y, P14H, P14L, P14S, T16A, T16I, T16S, F17I, F17L, F17V, F17Y, S18T, A20S, A20T, A20V, L21V, L22I, V23E, V23G, V24L, T25A, D28E, N29D, N29S, A30V, T31I, T31N, T31S, T33I, C34Y, S35N, F36I, F36L, F36Y, S37P, S37T, N38D, N38S, N38T, T39A, T39R, T39S, S40P, S40T, E41D, E41V, S42G, S42R, F43L, F43Y, V44H, V44M, V44R, L45I, L45V, N46I, N46V, Y48F, Y48H, Y48N, R49Y, R49L, M50D, M50E, M50I, M50L, M50Q, M50V, M50T, S51G, P52A, P52L, S53G, S53N, S53T, N54C, N54H, N54D, N54G, N54S, N54Y, Q55E, Q55H, Q55K, Q55R, T56A, T56L, T56M, T56P, T56S, T56V, D57F, D57R, D57V, D57Y, K58L, K58R, K58T, L59M, L59R, L59V, A61L, A61S, E64D, E64K, R66H, R66S, S67C, S67G, S67I, S67N, S67R, Q68E, Q68I, Q68L, Q68P, Q68R, Q68T, P69H, P69L, P69S, G70C, G70E, G70F, G70I, G70L, G70N, G70R, G70V, G70S, Q71H, Q71K, Q71L, Q71P, Q71R, D72A, D72G, D72N, C73A, C73G, C73H, C73P, C73S, C73R, C73Y, F75Y, R76G, R76H, R76S, V77D, V77I, T78I, T78S, Q79A, Q79P, Q79R, L80Q, P81S, N82S, R84H, R84Q, D85G, D85N, F86Y, H87L, H87Q, H87R, M88L, M88F, S89G, S89N, V90L, V90M, V91A, V91D, V91I, R92G, R92N, R92S, A93V, R94Q, R95L, R95K, R95G, N96D, N96S, N96T, T100A, T100I, T100S, Y101F, L102F, L102I, L102Y, L102V, G104A, G104T, G104S, G104V, A105C, A105G, A105I, A105L, A105V, I106L, S107A, S107F, S107L, S107T, S107V, L108F, L108I, L108T, L108Y, A109D, A109G, A109H, A109S, P110A, K111E, K111G, K111I, K111M, K111N, K111R, K111T, K111V, A112I, A112P, A112V, Q113R, Q113W, I114T, K115D, K115E, K115IN, K115N, K115Q, K115R, E116D, R119G, R119H, R119L, R119P, R119Q, R119W, A120V, T125A, T125K, T125I, T125S, T125V, R127F, R127L, R127K, R127S, R127V, R128G, R128M, A129S, E130K, V131A, V131E, V131I, V131R, P132H, P132R, P132S, P132T, T133A, T133R, T133S, A134D, A134V, H135N, H135R, H135Y, P136L, P136T, S137C, P138S, P138T, S139T, P140A, P140L, P140R, R141G, R141M, R141S, R141W, P142A, P142L, P142R, P142T, A143D, A143S, A143V, G144D, or G144S with reference to numbering of positions set forth in SEQ ID NO:37, or a conservative amino acid substitution thereof.

76. The immunomodulatory protein of embodiment 74 or embodiment 75, wherein the variant PD-1 polypeptide comprises an amino acid modification at one or more positions corresponding to an amino acid position 73, 86, 107, 112, 115, 119 or 120, with reference to numbering set forth in SEQ ID NO:37.

77. The immunomodulatory protein of any of embodiments 74-76, wherein the variant PD-1 polypeptide or a specific binding fragment thereof corresponding to amino acid modification(s) selected from C73A, C73G, C73H, C73P, C73R, C73S, C73Y, F86Y, S107T, A112V, K115D, K115E, K115I, K115N, K115Q, R119H, R119L, R119P, R119Q, R119W or A120V.

78. The immunomodulatory protein of any of embodiments 74-77, wherein the variant PD-1 polypeptide comprises 1, 2, 3, 4, 5, 6, 7, 8, 9, 10, 11, 12, 13, 14, 15, 16, 17, 18, 19 or 20 amino acid modifications, optionally wherein the amino acid modification is an amino acid substitution.

79. The immunomodulatory protein of any of embodiments 74-78, wherein the variant PD-1 polypeptide comprises one or more amino acid modifications in an unmodified PD-1 polypeptide or a specific binding fragment thereof corresponding to amino acid modification(s) selected from A112V/R119L/A120V; N13S/A120V/P142A; C34Y/N54D/T100S/A112V/A120V; M50V/S67N/L80Q/A120V/A143S; A112V/R119W; R84H/H87L/A112V/R119W; Q71R/V91I/A112V/R119L/A120V/T125S; A112V/K115E; M50L/L59V/R66H/A112V/H135Y/P138T/P142L; R119W; S53G/Q55R/A112V/K115E/A120V/S139T; R119W/H135R; A120V/T125I; A112V/A120V/V131A; F17I/K111E/A112V/A120V; S18T/R119Q/R141M; F36L/S37T/A112V/H135N/P138S; A112V/T125I; M50I/A112V/A120V; S67N/C73R/A93V/A112V/A120V; D72G/A112V/A120V; N96D/A112V/A120V/T125S; F86Y/R119W/T125I; R119P/T133R; K111M/A112V/K115E/P132H; S67G/A112V/T125I/T133S; A112V/A120V; S37P/A112V/R119W; W12L/S37P/A112V/R119W; D9G/A112V/A120V; T31S/S37T/A112V/T125I/A143S; S37T/A112V/T125I; R92G/A112V/A120V; E64D/F86Y/A112V/A120V; H87R/A112V/R119W; N13D/A105V/A112V/A120V/A134D; A112V/R119L/A120V/S137C; T16I/M50I/A112V/A120V; M50L/A112V/R119Q/A120V/T125I/H135R; D57V/A112V; S67N/R119W; S67N/A112V/A120V; N54Y/A112V/P140A; F43Y/P69L/R119W; N54Y/A112V/R119W; T56M/C73S/R76H/A112V/R119L/A120V/P132T/R141W; F17I/S40P/E41D/S67N/R95L/A112V/A120V/T125I/R141M; F17L/T31S/S35N/P81S/N96S/A112V/R119W; F43L/S67N/C73R/A112V/A120V; W12L/N38D/A112V/R119Q/A120V/P142T; S67N/P69H/C73R/Q79P/V91D/A112V/A120V/P136T/A143D; F17I/S40P/S67N/Q79R/A112V/R119W/T125I; F43Y/M50V/S67N/C73R/R92G/A112V/A120V/P136T; F17L/T56M/S67N/A112V/R119W/A120V/P142R; W12L/N54Y/S67N/F75Y/V91D/R95L/G104A/A112V/R119W/R141M; F17L/S37T/S67N/T78S/F86Y/A112V/R119H/A120V/V131E/A143V; N13D/S40P/A112V/R119L/A120V/S137C; F17V/A30V/E41V/R76S/A112V/R119Q/A120V/V131A; F17I/T25A/M50V/S53T/R66S/S67R/S107T/A112V/R119W/A143V; N13D/S40P/S67N/C73R/R95L/G104A/A112V/A120V; S40P/T56A/S67N/C73R/A112V/R119Q/A120V/V131A; N13Y/S40P/F43L/Q68P/R92G/A112V/R119L/A120V; F17L/S67N/Q71L/C73S/A112V/R119Q/A120V/P142L; F17I/S40P/P69S/C73S/N96S/G104A/A112V/A120V; F17I/S40P/A112V/R119L/A120V/P140R; A112V/A120V/T133S; A20S/S67N/C73R/R94Q/A112V/R119Q/A120V/T125I/P132S; N13D/S67N/C73R/R95L/A112V/R119Q/A120V/T125I; S40P/S67N/C73R/N96T/A112V/A120V; L21V/S40P/R95L/G104A/A112V/A120V/A129S/V131A/R141G; P14S/S40P/S42R/P52A/T56M/A112V/R119W/T125I/P142A; S40P/F43L/T56A/S67N/C73S/A112V/R119L/A120V; F17I/S40P/M50V/S67N/C73S/R95L/G104A/A112V/R119L/A120V; S40P/T56M/C73S/R95L/A112V/R119W/T125I/V131A/R141W; F17I/A20V/S51G/N54D/F86Y/A112V/A120V/T125I; F17I/T31N/T56M/S67N/C73R/G104A/A112V/R119Q/A120V/T133A/P140L; F17V/S40P/R92G/R95L/A112V/R119W; W12G/F17L/T56V/S67N/A112V/R119W/V131E/R141S; F86Y/R92G/A112V/R119L/A120V/T125K/T133S; P8T/F17I/S67N/F86Y/G104A/A112V/A120V/S139T; F17I/S40P/A112V/R119W/G144D L22I/S67I/G70S/Q71R/S107T/A112V/R119L/A120V/T125I/T133S; S40P/A112V/A120V; T16S/S67N/C73R/A112V/R119W; N13D/S40P/A112V/A120V/T125I/T133S; M50L/V91D/A112V/R119W/P132R/R141G; F17I/S40P/M50I/S67R/A112V/R119L/A120V/S137C; S40P/A112V/R119W; F17I/V24L/A112V/R119W; S40P/S67N/C73R/A93V/A112V/A120V; N13D/F17I/A112V/R119W/R141M; S67N/C73R/A112V/A120V/R141S; W12R/L59V/R66H/F86Y/V90L/A112V/K115N/R119L/A120V; F36L/M50I/S51G/C73R/S107T/K111M/A120V/V131E; M50V/R119W/A120V/T125I/R141G; A109G/A112V/K115E/R119W; Q55R/R76H/A112V/K115I/A120V; W12R/F86Y/R95L/A112V/R119P/T133R; S67N/C73Y/A112V; F17I/S40P/T56S/A112V; W12L/P14S/M50V/S67R/A93V/R94Q/K111T/A112V/R119W/A120V; F36L/L59R/S67N/A105L/A112V/R119W/A120V/A143V; L59M/E64K/F86Y/R94Q/A112V/R119L/A120V/T125I/T133S; P14H/F17Y/T39R/S40T/K58R/V77D/G104V/A112V/Q113R/I114T/A143V; D57V/L59M/P69S/C73S/A112V/R119L/A120V/A134V; V23E/T39S/S40P/C73Y/V91A/R92N/L102F/A112V/R119W/A120V; T16A/F17I/F36L/S67N/C73R/H87L/R92G/R95L/A112V/R119W; C73S/A105V/A112V/R119W/A120V/T133A; P14S/M50L/L59V/R66H/G70S/C73R/A112V/A120V/T125I/G144S; P8T/S40P/S53N/R95L/A112V/A120V/T125I/R128M/P138T/R141G; S37T/T56M/C73S/D85N/A109G/A112V/A120V/H135Y/A143S; S67N/C73R/A93V/G104A/A112V/R119Q/R127S/H135R; S40P/S67N/C73R/A112V/A120V; S67N/C73R/A93V/A112V/R119W; C73R/A93V/A112V/R119W; S67N/C73R/A112V/A120V; N13D/P69H/C73R/A93V/A112V/R119W/R141S; F17I/N38D/S40P/S67N/C73R/A112V/A120V; N13D/F17I/S40P/T56M/R66S/S67N/G70C/A112V/A120V/R141S; S40P/F43L/R66S/S67N/G70C/A112V/R119L/A120V; V23G/S40T/G104A/A112V/R119L/A120V; W12R/F36I/N54Y/S67I/C73S/A93V/G104A/A112V/K115Q/R119W; S40P/M50L/S67I/C73S/R92G/A93V/A112V/A120V/R141S; F17I/T25A/S40P/F43Y/S67N/C73R/F86Y/A112V/R119W/T125I; F17I/S40P/M50L/S67I/C73S/A112V/A120V/E130K/P136L; W12R/S40P/S67N/C73R/A93V/A112V/A120V/R141S; F17I/S40P/M50L/S67I/C73S/R92G/A93V/A112V/A120V/R141S; F17I/S40P/M50L/S67I/A112V/A120V/R141S; V23G/T56P/S67I/C73S/F86Y/R92G/G104A/A112V/R119W/A143D; F17I/S40P/M50L/S67I/C73S/R92G/A93V/A112V/R119W/T125I; D9V/P11A/N13D/S40T/T56M/S67N/R95L/G104A/A112V/R119L/A120V; F17I/T25A/S40P/F43Y/S67N/A112V/R119L/A120V; D9E/F17I/S40P/M50L/S67I/C73S/V90M/T100A/G104A/K111M/A112V/R119W/A120V/A143D; F17I/S40P/M50L/S67I/C73S/R92G/A93V/A112V/A120V/R141G; F17I/S40P/S67N/S89G/R95L/A112V/R119W/T125I; F17I/S40P/M50L/S67I/C73S/R92G/A93V/K111M/A112V/R119Q/A120V; D9N/F17I/T31N/S40P/M50L/S67I/C73S/R92G/A93V/A112V/A120V/R141S; N13D/S40T/T56M/S67N/R95L/G104A/K111R/A112V/A120V/T125I; W12G/F17I/S40P/M50L/A112V/P132T; D9N/F17I/S40P/M50T/T56A/G70S/C73R/R92G/A93V/A112V/A120V/R141S; N38S/L59M/Q71L/S107T/A112V/K115E/R119Q/A120V; M50V/L59M/A112V/R119Q/A120V P81S/F86Y/R92S/S107T/A112V/K115E/A120V; C73R/R84Q/F86Y/S107T/A112V/K115D/A120V; W12G/M50T/S53N/S67R/G70S/C73R/G104V/A112V/K115E/R119W; T31I/F36Y/F43Y/S67N/G70S/C73R/V90M/A112V/R119W; R76S/S107T/K111N/A112V/K115N/A120V; F86Y/A112V/

R119W/A120V; N13S/M50I/R76S/S107T/A112V/K115N/ R119W/A120V; P14H/T16S/M50L/C73R/R84Q/F86Y/ S107T/A112V/K115E/A120V; F17L/T25A/L59M/E64K/ F86Y/R94Q/S107T/A112V/K115N/R119W/A120V; Q71R/ F86Y/A112V/K115E/R119Q/A120V; R76S/S107T/A112V/ K115N/R119W/A120V; M50I/A112V/K115D/A120V; M50V/P81S/F86Y/R92S/S107T/A112V/K115E/A120V; M50I/S67N/G70R/K111T/A112V/R119W/A120V; P14H/ T16S/M50L/L80Q/K111M/R119Q/A120V; T31I/F36Y/ E64K/A112V/K115E/R119Q/A120V; S107T/A112V/ R119W/A120V; T56S/A112V/K115E/A120V; T56S/ A112V/R119W; N46I/Y48N/D57Y/S67C/V90L/A112V; T56S/A112V/R119P; P14H/F17I/V44M/A112V/K115E/ A120V; N38S/T56S/A112V/K115E/A120V; S42G/M50L/ P69S/F86Y/A112V/K115E; P14H/T56S/A112V/K115E/ A120V; N13S/S67N/G70C/F86Y/S89N/V91D/A112V/ R119L/A120V; W12G/S67N/Q71R/F86Y/K111M/A112V/ K115Q/R119W; S67N/C73R/V91D/S107T/K111M/ A112V/K115Q/R119W; N13S/M50I/R76S/S107T/K111M/ A112V/K115Q/R119W; T33I/S67N/G70S/S107T/K111N/ A112V/K115E/R119W; P69L/F86Y/V90M/T100I/S107T/ K111N/A112V/K115N/A120V; F17L/T25A/P69L/F86Y/ V90M/T100I/S107T/K111N/A112V/K115N/A120V; T33I/ M50I/R76S/F86Y/S107T/A112V/K115N/R119W/A120V; N13S/S67N/C73R/F86Y/S107T/A112V/Q113R/K115E/ A120V; S67N/C73R/F86Y/V91D/S107T/A112V/K115D/ A120V; F17L/T25A/S67N/C73R/R84Q/F86Y/A93V/ A112V/K115E/R119W; T56S/A112V/K115E P69L/V91D/A112V/K115N/R119W/A120V; N13S/E41D/M50I/G70V/D72N/F86Y/R94Q/A112V/R119L/A120V; M50I/P69L/F86Y/V90M/T100I/S107T/K111N/A112V/K115N/A120V; M50I/C73R/S107T/K111N/A112V/K115N/A120V; F86Y/A112V/K115N/R119W; M50I/S67N/C73R/F86Y/R95L/S107T/A112V/K115N/R119W; M50L/Q68R/P69S/F86Y/S107T/A112V/K115N/R119W; N38T/A112V/K115N/R119L/A120V; S67N/Q71H/F86Y/R95L/S107T/A112V/K115N/R119W; A20T/D28E/F36L/M50I/Q68R/P69S/F86Y/A112V/R119L/A120V; M50I/S67N/C73R/F86Y/R95L/A112V/Q113W/R119L/A120V; L59M/S67N/Q71L/C73R/R95L/S107T/A112V/K115N/R119W; P52L/S53N/C73S/A112V/E116D/R119W; Q71R/C73R/A112V/K115N/R119L/A120V; W12L/A20T/N29D/S37P/L59M/Q68R/P69S/F86Y/A112V/R119L/A120V; N46I/Y48F/D57V/P69L/A112V/K115N/R119W; M50I/S67N/C73R/F86Y/R95L/S107T/A112V/K115Q/R119Q/A120V; N54D/P69H/C73R/F86Y/R95L/S107T/A112V/K115N/R119W; T56S/Q71K/F86Y/R95L/S107T/A112V/K115N/R119W; C73A/F86Y/S107T/A112V/K115N/R119Q/A120V; C73R/F86Y/A105G/S107T/A112V/K115N/R119L/A120V; N54H/G70E/C73P/F86Y/A112V/K115D/R119L/A120V; C73G/F86Y/S107T/A112V/K115N/R119Q/A120V; N54S/C73G/F86Y/S107T/A112V/K115D/R119L/A120V; F86Y/S107T/A112V/K115D/R119W/A120V; G70E/C73P/F86Y/S107T/A112V/K115E/R119Q/A120V; C73G/F86Y/A105G/S107T/A112V/K115D/R119W; C73G/F86Y/S107T/A112V/K115D/R119L/A120V; C73S/F86Y/S107T/A112V/K115D/R119L/A120V; L45V/C73G/F86Y/G104A/S107T/A112V/K115N/R119W/A120V; C73P/F86Y/S107T/A112V/K115D/R119Q/A120V; C73S/F86Y/S107T/A112V/K115E/R119Q/A120V; C73S/F86Y/G104T/S107T/A112V/K115E/R119W/A120V; C73R/F86Y/S107T/K111R/A112V/K115D/A120V; P14L/C73G/F86Y/S107T/A112V/K115D/R119L/A120V; G70E/F86Y/S107T/A112V/K115D/R119L/A120V; C73G/F86Y/G104V/S107T/A112V/K115N/R119L/A120V; C73S/F86Y/G104S/S107T/L108F/A112V/K115D/R119L/A120V; C73S/F86Y/S107T/A112V/K115D/A120V; C73R/F86Y/S107T/A112V/K115D/R119L/A120V; C73S/F86Y/S107T/A112V/Q113R/K115D/R119L/A120V; C73S/F86Y/V91A/S107T/A112V/K115D/R119L/A120V; G70E/C73P/F86Y/A105G/S107T/A112V/K115D/R119Q/A120V; C73G/F86Y/A105G/S107T/A112V/K115D/R119L/A120V; C73G/F86Y/A105G/S107T/A112V/Q113R/K115D/R119L/A120V; F86Y/S107T/A112V/K115D/R119Q/A120V; C73R/F86Y/S107T/A112V/K115N/R119L/A120V; C73A/F86Y/S107T/A112V/Q113R/K115E/R119Q/A120V; C73R/F86Y/S107T/A112V/K115D/R119Q/A120V; C73G/F86Y/A112V/K115D/R119W/A120V; C73P/F86Y/A105G/S107T/A112V/Q113R/K115D/R119L/A120V; C73R/F86Y/A105G/S107T/A112V/K115D/R119L/A120V; C73A/F86Y/S107T/A112V/K115D/R119L/A120V; P69S/C73R/F86Y/S107T/A112V/K115D/R119W/A120V; C73S/F86Y/G104S/S107T/A112V/K115E/R119W/A120V; Q68R/C73S/F86Y/S107T/A112V/K115D/R119Q/A120V; C73R/F86Y/S107T/A112V/K115N/R119Q/A120V; G70E/C73R/F86Y/S107T/A112V/K115N/R119Q/A120V; C73S/F86Y/S107T/A112V/K115D/R119W/A120V; G70E/F86Y/G104T/I106L/S107T/L108T/A112V/K115N/R119L/A120V; C73H/F86Y/A105G/S107T/A112V/K115D/R119L/A120V; G70E/C73P/F86Y/A105C/S107T/A112V/K115D/R119L/A120V; G70E/C73P/F86Y/S107T/A112V/K115D/R119Q/A120V; C73S/F86Y/S107T/K111R/A112V/K115E/R119L/A120V; C73R/D85G/F86Y/A105G/S107T/A112V/K115D/R119Q/A120V; C73R/F86Y/S107T/A112V/K115E/R119W/A120V; N54S/C73G/F86Y/S107T/A112V/K115E/R119Q/A120V; C73S/F86Y/G104S/S107T/A112V/K115N/R119L/A120V; F17L/Q71R/C73G/F86Y/A105G/S107T/A112V/K115D/R119L/A120V; C73G/F86Y/S107T/A112V/K115E/R119W/A120V; G70E/C73G/F86Y/A105C/S107T/A112V/K115E/R119L/A120V; C73G/F86Y/G104A/S107T/A112V/K115D/R119W/A120V; C73S/F86Y/S107T/A112V/K115N/A120V; C73P/F86Y/S107T/A112V/K115N/R119L/A120V; W12R/F86Y/S107T/A112V/K115D/R119Q/A120V; G70E/C73G/F86Y/A105L/A112V/K115N/R119Q/A120V; F86Y/S107T/A112V/K115N/R119W/A120V, with reference to numbering of positions set forth in SEQ ID NO:37.

80. The immunomodulatory protein of any of embodiments 74-78, wherein the variant PD-1 polypeptide comprises the amino acid modifications V44H/L45V/N46I/Y48H/M50E/N54G/K58T/L102V/A105V/A112I, with reference to numbering of positions set forth in SEQ ID NO: 37.

81. The immunomodulatory protein of any of embodiments 75-80, wherein:

the unmodified PD-1 comprises (i) the sequence of amino acids set forth in SEQ ID NO:37, (ii) a sequence of amino acids that has at least 95% sequence identity to SEQ ID NO:37; or (iii) is a portion of (i) or (ii) comprising an IgV domain or specific binding fragment thereof; or the unmodified PD-1 comprises (i) the sequence of amino acids set forth in SEQ ID NO:392, (ii) a sequence of amino acids that has at least 95% sequence identity to SEQ ID NO:392; or (iii) is a portion of (i) or (ii) comprising an IgV domain or specific binding fragment thereof; or the unmodified PD-1 comprises (i) the sequence of amino acids set forth in SEQ ID NO:244, (ii) a sequence of amino acids that has at least 95% sequence identity to SEQ ID NO:244; or (iii) is a portion of (i) or (ii) comprising an IgV domain or specific binding fragment thereof.

82. The immunomodulatory protein of any of embodiments 74-81, wherein the variant PD-1 polypeptide comprises only the extracellular domain or a portion thereof containing the IgV domain or specific binding fragment thereof.

83. The immunomodulatory protein of any of embodiments 72-82, wherein the CD28-binding polypeptide comprises the extracellular domain or a portion thereof containing at least one immunoglobulin superfamily (IgSF) domain of an IgSF family member, or a variant thereof.

84. The immunomodulatory protein of any of embodiments 72-83, wherein the IgSF family member is ICOSL, CD80 or CD86, or a variant thereof that binds CD28.

85. The immunomodulatory protein of embodiment any of embodiments 72-84, wherein the CD28-binding polypeptide is or comprises a variant IgSF family member, said variant IgSF family member comprising one more amino acid modifications in an unmodified IgSF family member that increases binding affinity for CD28 compared to the unmodified IgSF family member.

86. The immunomodulatory protein of any of embodiments 72-85, wherein:
the CD28-binding polypeptide is or comprises a variant ICOSL comprising the extracellular domain or a portion thereof containing at least one IgSF domain, said variant ICOSL comprising one or more amino acid modifications in an unmodified ICOSL polypeptide that increases binding affinity for CD28 compared to the unmodified ICOSL polypeptide; or
the CD28-binding polypeptide is or comprises a variant CD86 comprising the extracellular domain or a portion thereof containing at least one IgSF domain, said variant CD86 comprising one or more amino acid modifications in an unmodified CD86 polypeptide that increases binding affinity for CD28 compared to the unmodified CD86 polypeptide.

87. The immunomodulatory protein of embodiment 85 or embodiment 86, wherein the increase in binding affinity for binding to CD28 is greater than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold.

88. The immunomodulatory protein of any of embodiments 83-87, wherein:
the second polypeptide is not the full-length sequence of the IgSF member; and/or
the second polypeptide only contains the extracellular domain or at least one IgSF domain or specific binding fragment thereof of the IgSF member, optionally wherein the IgSF domain is an IgV domain or an IgC domain.

89. The immunomodulatory protein of any of embodiments 83-88, wherein the at least one IgSF domain comprises an IgV domain or specific binding fragment thereof, an IgC domain or a specific binding fragment thereof, or both.

90. The immunomodulatory protein of any of embodiments 83-88, wherein the at least one IgSF domain consists of an IgV domain or specific binding fragment thereof, an IgC domain or a specific binding fragment thereof, or both.

91. The immunomodulatory protein of any of embodiments 72-90, wherein the variant PD-1 polypeptide and the CD28-binding polypeptide are linked directly or indirectly via a linker.

92. The immunomodulatory protein of embodiment 91, wherein the linker is a peptide linker.

93. The immunomodulatory protein of embodiment 92, wherein the peptide linker is selected from GGGGS (G4S; SEQ ID NO: 472), GSGGGGS (SEQ ID NO: 471), GGGGSGGGGS (2×GGGGS; SEQ ID NO: 474), GGGGSGGGGSGGGGS (3×GGGGS; SEQ ID NO: 473), or combinations thereof 94. The immunomodulatory protein of any of embodiments 72-93, wherein the variant PD-1 is amino-terminal to the CD28-binding polypeptide.

95. The immunomodulatory protein of any of embodiments 72-93, wherein the variant PD-1 polypeptide is carboxy-terminal to the CD28-binding polypeptide.

96. The immunomodulatory protein of any of embodiments 72-95, wherein the immunomodulatory protein is a monomer and/or comprises a single polypeptide chain.

97. The immunomodulatory protein of any of embodiments 72-95, wherein the immunomodulatory protein is a dimer, optionally wherein each polypeptide of the dimer is linked to a multimerization domain.

98. The immunomodulatory protein of embodiment 97, wherein the immunomodulatory protein is a homodimer.

99. The immunomodulatory protein of any of embodiments 72-98, wherein the immunomodulatory protein comprises: (a) a first polypeptide chain comprising the variant PD-1 polypeptide, the CD28-binding polypeptide and a first multimerization domain, and (b) a second polypeptide chain comprising the variant PD-1 polypeptide, the CD28-binding polypeptide and a second multimerization domain, whereby the immunomodulatory protein is a multimer comprising the first polypeptide and the second polypeptide.

100. The immunomodulatory protein of embodiment 99, wherein the first and second multimerization domain are the same.

101. The immunomodulatory protein of any of embodiments 69-71 and 97-100, wherein the multimerization domain is an Fc domain of an immunoglobulin, optionally wherein the immunoglobulin protein is human and/or the Fc region is human.

102. The immunomodulatory protein of embodiment 101, wherein the Fc domain is an IgG1, IgG2 or IgG4, or is a variant thereof with reduced effector function.

103. The immunomodulatory protein of embodiment 102, wherein the Fc domain is an IgG1 Fc domain, optionally a human IgG1, or is a variant thereof with reduced effector function.

104. The immunomodulatory protein of embodiment 103, wherein Fc domain is a variant IgG1 comprising one or more amino acid substitutions and the one or more amino acid substitutions are selected from E233P, L234A, L234V, L235A, L235E, G236del, G237A, S267K, or N297G, each numbered according to EU index by Kabat.

105. The immunomodulatory protein of embodiment 104, wherein the Fc region comprises the amino acid substitution N297G, the amino acid substitutions R292C/N297G/V302C, or the amino acid substitutions L234A/L235E/G237A, each numbered according to the EU index of Kabat.

106. The immunomodulatory protein of embodiment 104 or embodiment 105, wherein the variant Fc region further comprises the amino acid substitution C220S, wherein the residues are numbered according to the EU index of Kabat.

107. The immunomodulatory protein of any of embodiments 104-106, wherein the Fc region comprises K447del, wherein the residue is numbered according to the EU index of Kabat.

108. The immunomodulatory protein of any of embodiments 104-107, wherein the Fc region comprises the sequence of amino acids set forth in SEQ ID NO:384 or 476, or a sequence of amino acids that exhibits at least 85%, 86%, 87%, 88%, 89%, 90%, 91%, 92%, 93%, 94%, 95%, 96%, 97%, 98% or 99% sequence identity to SEQ ID NO:384 or 476, and contains the amino acid substitutions therein and/or exhibits reduced effector function.

109. The immunomodulatory protein of any of embodiments 72-108, wherein the immunomodulatory protein exhibits PD-L1-dependent CD28 costimulation.

110. A conjugate, comprising a variant PD-1 polypeptide of any of embodiments 1-66 linked to a targeting moiety that specifically binds to a molecule on the surface of a cell.

111. The conjugate of embodiment 110, wherein the cell is an immune cell or is a tumor cell.

112. The conjugate of embodiment 110 or embodiment 111, wherein the moiety is a protein, a peptide, nucleic acid, small molecule or nanoparticle.

113. The conjugate of any of embodiments 110-112, wherein the moiety is an antibody or antigen-binding fragment.

114. The conjugate of any of embodiments 111-113 that is a fusion protein.

115. A nucleic acid molecule(s) encoding a variant PD-1 polypeptide of any of embodiments 1-66, an immunomodulatory protein of any of embodiments 67-109 or a conjugate that is a fusion protein of any of embodiments 111-114.

116. The nucleic acid molecule of embodiment 115 that is a synthetic nucleic acid.

117. The nucleic acid molecule of embodiment 115 or embodiment 116 that is a cDNA.

118. A vector, comprising the nucleic acid molecule of any of embodiments 115-117.

119. The vector of embodiment 118 that is an expression vector.

120. The vector of embodiment 118 or embodiment 119, wherein the vector is a mammalian expression vector or a viral vector.

121. A cell, comprising the vector of any of embodiments 118-120.

122. The cell of embodiment 121 that is a mammalian cell.

123. The cell of embodiment 121 or embodiment 122 that is a human cell.

124. A method of producing a protein comprising a variant PD-1 polypeptide, comprising introducing the nucleic acid molecule of any of embodiments 115-117 or vector of any of embodiments 118-120 into a host cell under conditions to express the protein in the cell.

125. The method of embodiment 124, further comprising isolating or purifying the protein from the cell.

126. A method of engineering a cell expressing a variant PD-1 variant polypeptide, the method comprising introducing a nucleic acid molecule encoding the variant PD-1 polypeptide of any of embodiments 1-66, immunomodulatory protein of any of embodiments 67-109, or a conjugate that is a fusion protein of any of embodiments 111-114 into a host cell under conditions in which the polypeptide is expressed in the cell.

127. An engineered cell, comprising a variant PD-1 polypeptide of any of embodiments 1-66, an immunomodulatory protein of any of embodiments 67-109, a conjugate that is a fusion protein of any of embodiments 111-114, a nucleic acid molecule of any of embodiments 115-117 or a vector of any of embodiments 118-120.

128. The engineered cell of embodiment 127, wherein the protein comprising a variant PD-1 polypeptide is capable of being secreted from the engineered cell.

129. The engineered cell of embodiment 127 or embodiment 128, wherein:
the protein does not comprise a cytoplasmic signaling domain or transmembrane domain and/or is not expressed on the surface of the cell; and/or
the protein is capable of being secreted from the engineered cell when expressed.

130. A transmembrane immunomodulatory protein comprising:
an ecotodomain comprising an extracellular domain or specific binding fragment thereof of a variant PD-1, wherein the extracellular domain or a portion thereof comprises an IgV domain or specific binding fragment thereof, wherein the variant PD-1 polypeptide exhibits increased binding affinity for the ectodomain of PD-L1 compared to the binding affinity of the unmodified PD-1 polypeptide for the ectodomain of PD-L1;
a transmembrane domain; and
an intracellular signaling domain comprising a signaling region of an activating receptor or one or more signaling region of a costimulatory molecule.

131. The transmembrane immunomodulatory protein of embodiment 130, wherein the activating receptor is or comprises at least one ITAM (immunoreceptor tyrosine-based activation motif)-containing signaling domain.

132. The transmembrane immunomodulatory protein of embodiment 131, wherein the activating receptor is or comprises an intracellular signaling domain of a CD3-zeta chain, optionally wherein the CD3-zeta chain is a human CD3-zeta chain or comprises the sequence of amino acids set forth in SEQ ID NO: 607 or a sequence of amino acids that has at least 90% sequence identity to SEQ ID NO:607.

133. The transmembrane immunomodulatory protein of any of embodiments 130-132, wherein the one or more signaling region of a costimulatory molecule is a signaling region of at least one of a CD28, an ICOS or a 4-1BB.

134. The transmembrane immunomodulatory protein of embodiment 133, wherein the at least one of the costimulatory signaling region comprises a costimulatory signaling region of CD28 and ICOS.

135. The transmembrane immunomodulatory protein of embodiment 133, wherein the at least one of the costimulatory signaling region comprises a costimulatory signaling region of CD28 and 41BB.

136. The transmembrane immunomodulatory protein of embodiment 133, wherein the at least one of the costimulatory signaling region comprises a costimulatory signaling region of ICOS and 41BB.

137. The transmembrane immunomodulatory protein of embodiment 133, wherein the at least one of the costimulatory signaling region comprises a costimulatory signaling region of CD28, ICOS and 41BB.

138. The transmembrane immunomodulatory protein of embodiment 133, 134, 135 or 137, wherein at least one of the costimulatory signaling region is a costimulatory signaling region of a human CD28 or has the sequence of amino acids set forth in any of SEQ ID NO:614-616 or a sequence of amino acids that has at least 90% sequence identity to any of SEQ ID NOS: 614-616.

139. The transmembrane immunomodulatory protein of embodiment 133, 135, 136 or 137, wherein the at least one of the of the costimulatory signaling region is a costimulatory signaling region of a human 41BB or has the sequence of amino acids set forth in SEQ ID NO: 613 or a sequence of amino acids that has at least 90% sequence identity to SEQ ID NOS: 613.

140. The transmembrane immunomodulatory protein of embodiment 133, 134, 136 or 137, wherein the at least one of the of the costimulatory signaling region is a costimulatory signaling region of a human ICOS or has the sequence of amino acids set forth in any of SEQ ID NO: 992 or a sequence of amino acids that has at least 90% sequence identity to any of SEQ ID NOS: 992.

141. The transmembrane immunomodulatory protein of any of embodiments 130-140, wherein the transmembrane domain is a transmembrane domain of a costimulatory molecule.

142. The transmembrane immunomodulatory protein of embodiment 141, wherein the transmembrane domain of the costimulatory molecule is a transmembrane domain of CD28, ICOS or 41BB.

143. The transmembrane immunomodulatory protein of embodiment 141 or embodiment 142, wherein the transmembrane domain and costimulatory signaling region is from the same costimulatory molecule.

144. The transmembrane immunomodulatory protein of any of embodiments 130-143, further comprising a spacer between the ectodomain and the transmembrane domain.

145. The transmembrane immunomodulatory protein of embodiment 144, wherein the spacer is from or from about 10 to 100 amino acids in length, from or from about 10 to 75 amino acids in length, from or from about 10 to 50 amino acids in length, from or from about 10 to 20 amino acids in length, from or from about 20 to 100 amino acids in length, from or from about 20 to 75 amino acids in length, from or from about 20 to 50 amino acids in length, from or from about 50 to 100 amino acids in length, from or from about 50 to 75 amino acids in length or from or from about 75 to 100 amino acids in length.

146. The transmembrane immunomodulatory protein of embodiment 144 or embodiment 145, wherein the spacer is from an immunoglobulin, optionally wherein the spacer comprises a hinge region of an immunoglobulin.

147. The transmembrane immunomodulatory protein of embodiment 144 or embodiment 145, wherein the spacer is or comprises a CD8 hinge or a variant thereof 148. The transmembrane immunomodulatory protein of any of embodiments 130-147, wherein the binding affinity is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 60-fold, 80-fold, 100-fold, I50-fold, 200-fold, 250-fold, 300-fold, 400-fold, or 450-fold compared to binding affinity of the unmodified PD-1 for the ectodomain of PD-L1.

149. The transmembrane immunomodulatory protein of any of embodiments 130-148, wherein the variant PD-1 polypeptide comprises one or more amino acid modifications in an unmodified PD-1 polypeptide or a specific binding fragment thereof corresponding to amino acid modification(s) selected from an amino acid substitution P8T, D9E, D9G, D9N, D9V, P11A, W12G, W12L, W12R, N13D, N13S, N13Y, P14H, P14L, P14S, T16A, T16I, T16S, F17I, F17L, F17V, F17Y, S18T, A20S, A20T, A20V, L21V, L22I, V23E, V23G, V24L, T25A, D28E, N29D, N29S, A30V, T31I, T31N, T31S, T33I, C34Y, S35N, F36I, F36L, F36Y, S37P, S37T, N38D, N38S, N38T, T39A, T39R, T39S, S40P, S40T, E41D, E41V, S42G, S42R, F43L, F43Y, V44H, V44M, V44R, L45I, L45V, N46I, N46V, Y48F, Y48H, Y48N, R49Y, R49L, M50D, M50E, M50I, M50L, M50Q, M50V, M50T, S51G, P52A, P52L, S53D, S53G, S53L, S53N, S53T, S53V, N54C, N54H, N54D, N54G, N54S, N54Y, Q55E, Q55H, Q55K, Q55R, T56A, T56L, T56M, T56P, T56S, T56V, D57F, D57R, D57V, D57Y, K58L, K58R, K58T, L59M, L59R, L59V, A61L, A61S, E64D, E64K, R66H, R66S, S67C, S67G, S67I, S67N, S67R, Q68E, Q68I, Q68L, Q68P, Q68R, Q68T, P69H, P69L, P69S, G70C, G70E, G70F, G70I, G70L, G70N, G70R, G70V, G70S, Q71H, Q71K, Q71L, Q71P, Q71R, D72A, D72G, D72N, C73A, C73G, C73H, C73P, C73S, C73R, C73Y, F75Y, R76G, R76H, R76S, V77D, V77I, T78I, T78S, Q79A, Q79P, Q79R, L80Q, P81S, N82S, R84H, R84Q, D85G, D85N, F86Y, H87L, H87Q, H87R, M88L, M88F, S89G, S89N, V90L, V90M, V91A, V91D, V91I, R92G, R92N, R92S, A93V, R94Q, R95L, R95K, R95G, N96D, N96S, N96T, T100A, T100I, T100S, Y101F, L102F, L102I, L102Y, L102V, G104A, G104T, G104S, G104V, A105C, A105G, A105I, A105L, A105V, I106L, S107A, S107F, S107L, S107T, S107V, L108F, L108I, L108T, L108Y, A109D, A109G, A109H, A109S, P110A, K111E, K111G, K111I, K111M, K111N, K111R, K111T, K111V, A112I, A112P, A112V, Q113R, Q113W, I114T, K115D, K115E, K115IN, K115N, K115Q, K115R, E116D, R119G, R119H, R119L, R119P, R119Q, R119W, A120V, T125A, T125K, T125I, T125S, T125V, R127F, R127L, R127K, R127S, R127V, R128G, R128M, A129S, E130K, V131A, V131E, V131I, V131R, P132H, P132R, P132S, P132T, T133A, T133R, T133S, A134D, A134V, H135N, H135R, H135Y, P136L, P136T, S137C, P138S, P138T, S139T, P140A, P140L, P140R, R141G, R141M, R141S, R141W, P142A, P142L, P142R, P142T, A143D, A143S, A143V, G144D, or G144S with reference to numbering of positions set forth in SEQ ID NO:37, or a conservative amino acid substitution thereof.

150. The transmembrane immunomodulatory protein of any of embodiments 130-149, wherein the variant PD-1 polypeptide comprises an amino acid modification at one or more positions corresponding to an amino acid position 73, 86, 107, 112, 115, 119 or 120, with reference to numbering set forth in SEQ ID NO:37.

151. The transmembrane immunomodulatory protein of any of embodiments 130-150, wherein the variant PD-1 polypeptide comprises one or more amino acid modifications in an unmodified PD-1 polypeptide or a specific binding fragment thereof corresponding to amino acid modification(s) selected from C73A, C73G, C73H, C73P, C73R, C73S, C73Y, F86Y, S107T, A112V, K115D, K115E, K115I, K115N, K115Q, R119H, R119L, R119P, R119Q, R119W or A120V, with reference to numbering of positions set forth in SEQ ID NO: 37.

152. The transmembrane immunomodulatory protein of any of embodiments 130-151, wherein the variant PD-1 polypeptide comprises 1, 2, 3, 4, 5, 6, 7, 8, 9, 10, 11, 12, 13, 14, 15, 16, 17, 18, 19 or 20 amino acid modifications, optionally wherein the amino acid modification is an amino acid substitution.

153. The transmembrane immunomodulatory protein of any of embodiments 130-152, wherein the variant PD-1 polypeptide comprises one or more amino acid modifications in an unmodified PD-1 polypeptide or a specific binding fragment thereof corresponding to amino acid modification(s) selected from A112V/R119L/A120V; N13S/A120V/P142A; C34Y/N54D/T100S/A112V/A120V; M50V/S67N/L80Q/A120V/A143S; A112V/R119W; R84H/H87L/A112V/R119W; Q71R/V91I/A112V/R119L/A120V/T125S; A112V/K115E; M50L/L59V/R66H/A112V/H135Y/P138T/P142L; R119W; S53G/Q55R/A112V/K115E/A120V/S139T; R119W/H135R; A120V/T125I; A112V/A120V/V131A; F17I/K111E/A112V/A120V; S18T/R119Q/R141M; F36L/S37T/A112V/H135N/P138S; A112V/T125I; M50I/A112V/A120V; S67N/C73R/A93V/A112V/A120V; D72G/A112V/A120V; N96D/A112V/A120V/T125S; F86Y/R119W/T125I; R119P/T133R; K111M/A112V/K115E/P132H; S67G/A112V/T125I/T133S; A112V/A120V; S37P/A112V/R119W; W12L/S37P/A112V/R119W; D9G/A112V/A120V; T31S/S37T/A112V/T125I/A143S; S37T/A112V/T125I; R92G/A112V/A120V;

E64D/F86Y/A112V/A120V; H87R/A112V/R119W; N13D/ A105V/A112V/A120V/A134D; A112V/R119L/A120V/ S137C; T16I/M50I/A112V/A120V; M50L/A112V/R119Q/ A120V/T125I/H135R; D57V/A112V; S67N/R119W; S67N/ A112V/A120V; N54Y/A112V/P140A; F43Y/P69L/ R119W; N54Y/A112V/R119W; T56M/C73S/R76H/ A112V/R119L/A120V/P132T/R141W; F17I/S40P/E41D/ S67N/R95L/A112V/A120V/T125I/R141M; F17L/T31S/ S35N/P81S/N96S/A112V/R119W; F43L/S67N/C73R/ A112V/A120V; W12L/N38D/A112V/R119Q/A120V/ P142T; S67N/P69H/C73R/Q79P/V91D/A112V/A120V/ P136T/A143D; F17I/S40P/S67N/Q79R/A112V/R119W/ T125I; F43Y/M50V/S67N/C73R/R92G/A112V/A120V/ P136T; F17L/T56M/S67N/A112V/R119W/A120V/P142R; W12L/N54Y/S67N/F75Y/V91D/R95L/G104A/A112V/ R119W/R141M; F17L/S37T/S67N/T78S/F86Y/A112V/ R119H/A120V/V131E/A143V; N13D/S40P/A112V/ R119L/A120V/S137C; F17V/A30V/E41V/R76S/A112V/ R119Q/A120V/V131A; F17I/T25A/M50V/S53T/R66S/ S67R/S107T/A112V/R119W/A143V; N13D/S40P/S67N/ C73R/R95L/G104A/A112V/A120V; S40P/T56A/S67N/ C73R/A112V/R119Q/A120V/V131A; N13Y/S40P/F43L/ Q68P/R92G/A112V/R119L/A120V; F17L/S67N/Q71L/C73S/A112V/R119Q/A120V/P142L; F17I/S40P/P69S/C73S/N96S/G104A/A112V/A120V; F17I/S40P/A112V/R119L/A120V/P140R; A112V/A120V/T133S; A20S/S67N/C73R/R94Q/A112V/R119Q/A120V/T125I/P132S; N13D/S67N/C73R/R95L/A112V/R119Q/A120V/T125I; S40P/S67N/C73R/N96T/A112V/A120V; L21V/S40P/R95L/G104A/A112V/A120V/A129S/V131A/R141G; P14S/S40P/S42R/P52A/T56M/A112V/R119W/T125I/P142A; S40P/F43L/T56A/S67N/C73S/A112V/R119L/A120V; F17I/S40P/M50V/S67N/C73S/R95L/G104A/A112V/R119L/A120V; S40P/T56M/C73S/R95L/A112V/R119W/T125I/V131A/R141W; F17I/A20V/S51G/N54D/F86Y/A112V/A120V/T125I; F17I/T31N/T56M/S67N/C73R/G104A/A112V/R119Q/A120V/T133A/P140L; F17V/S40P/R92G/R95L/A112V/R119W; W12G/F17L/T56V/S67N/A112V/R119W/V131E/R141S; F86Y/R92G/A112V/R119L/A120V/T125K/T133S; P8T/F17I/S67N/F86Y/G104A/A112V/A120V/S139T; F17I/S40P/A112V/R119W/G144D L22I/S67I/G70S/Q71R/S107T/A112V/R119L/A120V/T125I/T133S; S40P/A112V/A120V; T16S/S67N/C73R/A112V/R119W; N13D/S40P/A112V/A120V/T125I/T133S; M50L/V91D/A112V/R119W/P132R/R141G; F17I/S40P/M50I/S67R/A112V/R119L/A120V/S137C; S40P/A112V/R119W; F17I/V24L/A112V/R119W; S40P/S67N/C73R/A93V/A112V/A120V; N13D/F17I/A112V/R119W/R141M; S67N/C73R/A112V/A120V/R141S; W12R/L59V/R66H/F86Y/V90L/A112V/K115N/R119L/A120V; F36L/M50I/S51G/C73R/S107T/K111M/A120V/V131E; M50V/R119W/A120V/T125I/R141G; A109G/A112V/K115E/R119W; Q55R/R76H/A112V/K115I/A120V; W12R/F86Y/R95L/A112V/R119P/T133R; S67N/C73Y/A112V; F17I/S40P/T56S/A112V; W12L/P14S/M50V/S67R/A93V/R94Q/K111T/A112V/R119W/A120V; F36L/L59R/S67N/A105L/A112V/R119W/A120V/A143V; L59M/E64K/F86Y/R94Q/A112V/R119L/A120V/T125I/T133S; P14H/F17Y/T39R/S40T/K58R/V77D/G104V/A112V/Q113R/I114T/A143V; D57V/L59M/P69S/C73S/A112V/R119L/A120V/A134V; V23E/T39S/S40P/C73Y/V91A/R92N/L102F/A112V/R119W/A120V; T16A/F17I/F36L/S67N/C73R/H87L/R92G/R95L/A112V/R119W; C73S/A105V/A112V/R119W/A120V/T133A; P14S/M50L/L59V/R66H/G70S/C73R/A112V/A120V/T125I/G144S; P8T/S40P/S53N/R95L/A112V/A120V/T125I/R128M/P138T/R141G; S37T/T56M/C73S/D85N/A109G/A112V/A120V/H135Y/

A143S; S67N/C73R/A93V/G104A/A112V/R119Q/R127S/H135R; S40P/S67N/C73R/A112V/A120V; S67N/C73R/A93V/A112V/R119W; C73R/A93V/A112V/R119W; S67N/C73R/A112V/A120V; N13D/P69H/C73R/A93V/A112V/R119W/R141S; F17I/N38D/S40P/S67N/C73R/A112V/A120V; N13D/F17I/S40P/T56M/R66S/S67N/G70C/A112V/A120V/R141S; S40P/F43L/R66S/S67N/G70C/A112V/R119L/A120V; V23G/S40T/G104A/A112V/R119L/A120V; W12R/F36I/N54Y/S67I/C73S/A93V/G104A/A112V/K115Q/R119W; S40P/M50L/S67I/C73S/R92G/A93V/A112V/A120V/R141S; F17I/T25A/S40P/F43Y/S67N/C73R/F86Y/A112V/R119W/T125I; F17I/S40P/M50L/S67I/C73S/A112V/A120V/E130K/P136L; W12R/S40P/S67N/C73R/A93V/A112V/A120V/R141S; F17I/S40P/M50L/S67I/C73S/R92G/A93V/A112V/A120V/R141S; F17I/S40P/M50L/S67I/A112V/A120V/R141S; V23G/T56P/S67I/C73S/F86Y/R92G/G104A/A112V/R119W/A143D; F17I/S40P/M50L/S67I/C73S/R92G/A93V/A112V/R119W/T125I; D9V/P11A/N13D/S40T/T56M/S67N/R95L/G104A/A112V/R119L/A120V; F17I/T25A/S40P/F43Y/S67N/A112V/R119L/A120V; D9E/F17I/S40P/M50L/S67I/C73S/V90M/T100A/G104A/K111M/A112V/R119W/A120V/A143D; F17I/S40P/M50L/S67I/C73S/R92G/A93V/A112V/A120V/R141G; F17I/S40P/S67N/S89G/R95L/A112V/R119W/T125I; F17I/S40P/M50L/S67I/C73S/R92G/A93V/K111M/A112V/R119Q/A120V; D9N/F17I/T31N/S40P/M50L/S67I/C73S/R92G/A93V/A112V/A120V/R141S; N13D/S40T/T56M/S67N/R95L/G104A/K111R/A112V/A120V/T125I; W12G/F17I/S40P/M50L/A112V/P132T; D9N/F17I/S40P/M50T/T56A/G70S/C73R/R92G/A93V/A112V/A120V/R141S; N38S/L59M/Q71L/S107T/A112V/K115E/R119Q/A120V; M50V/L59M/A112V/R119Q/A120V P81S/F86Y/R92S/S107T/A112V/K115E/A120V; C73R/R84Q/F86Y/S107T/A112V/K115D/A120V; W12G/M50T/S53N/S67R/G70S/C73R/G104V/A112V/K115E/R119W; T31I/F36Y/F43Y/S67N/G70S/C73R/V90M/A112V/R119W; R76S/S107T/K111N/A112V/K115N/A120V; F86Y/A112V/R119W/A120V; N13S/M50I/R76S/S107T/A112V/K115N/R119W/A120V; P14H/T16S/M50L/C73R/R84Q/F86Y/S107T/A112V/K115E/A120V; F17L/T25A/L59M/E64K/F86Y/R94Q/S107T/A112V/K115N/R119W/A120V; Q71R/F86Y/A112V/K115E/R119Q/A120V; R76S/S107T/A112V/K115N/R119W/A120V; M50I/A112V/K115D/A120V; M50V/P81S/F86Y/R92S/S107T/A112V/K115E/A120V; M50I/S67N/G70R/K111T/A112V/R119W/A120V; P14H/T16S/M50L/L80Q/K111M/R119Q/A120V; T31I/F36Y/E64K/A112V/K115E/R119Q/A120V; S107T/A112V/R119W/A120V; T56S/A112V/K115E/A120V; T56S/A112V/R119W; N46I/Y48N/D57Y/S67C/V90L/A112V; T56S/A112V/R119P; P14H/F17I/V44M/A112V/K115E/A120V; N38S/T56S/A112V/K115E/A120V; S42G/M50L/P69S/F86Y/A112V/K115E; P14H/T56S/A112V/K115E/A120V; N13S/S67N/G70C/F86Y/S89N/V91D/A112V/R119L/A120V; W12G/S67N/Q71R/F86Y/K111M/A112V/K115Q/R119W; S67N/C73R/V91D/S107T/K111M/A112V/K115Q/R119W; N13S/M50I/R76S/S107T/K111M/A112V/K115Q/R119W; T33I/S67N/G70S/S107T/K111N/A112V/K115E/R119W; P69L/F86Y/V90M/T100I/S107T/K111N/A112V/K115N/A120V; F17L/T25A/P69L/F86Y/V90M/T100I/S107T/K111N/A112V/K115N/A120V; T33I/M50I/R76S/F86Y/S107T/A112V/K115N/R119W/A120V; N13S/S67N/C73R/F86Y/S107T/A112V/Q113R/K115E/A120V; S67N/C73R/F86Y/V91D/S107T/A112V/K115D/A120V; F17L/T25A/S67N/C73R/R84Q/F86Y/A93V/A112V/K115E/R119W; T56S/A112V/K115E P69L/V91D/A112V/K115N/R119W/A120V; N13S/E41D/M50I/G70V/

D72N/F86Y/R94Q/A112V/R119L/A120V; M50I/P69L/F86Y/V90M/T100I/S107T/K111N/A112V/K115N/A120V; M50I/C73R/S107T/K111N/A112V/K115N/A120V; F86Y/A112V/K115N/R119W; M50I/S67N/C73R/F86Y/R95L/S107T/A112V/K115N/R119W; M50L/Q68R/P69S/F86Y/S107T/A112V/K115N/R119W; N38T/A112V/K115N/R119L/A120V; S67N/Q71H/F86Y/R95L/S107T/A112V/K115N/R119W; A20T/D28E/F36L/M50I/Q68R/P69S/F86Y/A112V/R119L/A120V; M50I/S67N/C73R/F86Y/R95L/A112V/Q113W/R119L/A120V; L59M/S67N/Q71L/C73R/R95L/S107T/A112V/K115N/R119W; P52L/S53N/C73S/A112V/E116D/R119W; Q71R/C73R/A112V/K115N/R119L/A120V; W12L/A20T/N29D/S37P/L59M/Q68R/P69S/F86Y/A112V/R119L/A120V; N46I/Y48F/D57V/P69L/A112V/K115N/R119W; M50I/S67N/C73R/F86Y/R95L/S107T/A112V/K115Q/R119Q/A120V; N54D/P69H/C73R/F86Y/R95L/S107T/A112V/K115N/R119W; T56S/Q71K/F86Y/R95L/S107T/A112V/K115N/R119W; C73A/F86Y/S107T/A112V/K115N/R119Q/A120V; C73R/F86Y/A105G/S107T/A112V/K115N/R119L/A120V; N54H/G70E/C73P/F86Y/A112V/K115D/R119L/A120V; C73G/F86Y/S107T/A112V/K115N/R119Q/A120V; N54S/C73G/F86Y/S107T/A112V/K115D/R119L/A120V; F86Y/S107T/A112V/K115D/R119W/A120V; G70E/C73P/F86Y/S107T/A112V/K115E/R119Q/A120V; C73G/F86Y/A105G/S107T/A112V/K115D/R119W; C73G/F86Y/S107T/A112V/K115D/R119L/A120V; C73S/F86Y/S107T/A112V/K115D/R119L/A120V; L45V/C73G/F86Y/G104A/S107T/A112V/K115N/R119W/A120V; C73P/F86Y/S107T/A112V/K115D/R119Q/A120V; C73S/F86Y/S107T/A112V/K115E/R119Q/A120V; C73S/F86Y/G104T/S107T/A112V/K115E/R119W/A120V; C73R/F86Y/S107T/K111R/A112V/K115D/A120V; P14L/C73G/F86Y/S107T/A112V/K115D/R119L/A120V; G70E/F86Y/S107T/A112V/K115D/R119L/A120V; C73G/F86Y/G104V/S107T/A112V/K115N/R119L/A120V; C73S/F86Y/G104S/S107T/L108F/A112V/K115D/R119L/A120V; C73S/F86Y/S107T/A112V/K115D/A120V; C73R/F86Y/S107T/A112V/K115D/R119L/A120V; C73S/F86Y/S107T/A112V/Q113R/K115D/R119L/A120V; C73S/F86Y/V91A/S107T/A112V/K115D/R119L/A120V; G70E/C73P/F86Y/A105G/S107T/A112V/K115D/R119Q/A120V; C73G/F86Y/A105G/S107T/A112V/K115D/R119L/A120V; C73G/F86Y/A105G/S107T/A112V/Q113R/K115D/R119L/A120V; F86Y/S107T/A112V/K115D/R119Q/A120V; C73R/F86Y/S107T/A112V/K115N/R119L/A120V; C73A/F86Y/S107T/A112V/Q113R/K115E/R119Q/A120V; C73R/F86Y/S107T/A112V/K115D/R119Q/A120V; C73G/F86Y/A112V/K115D/R119W/A120V; C73P/F86Y/A105G/S107T/A112V/Q113R/K115D/R119L/A120V; C73R/F86Y/A105G/S107T/A112V/K115D/R119L/A120V; C73A/F86Y/S107T/A112V/K115D/R119L/A120V; P69S/C73R/F86Y/S107T/A112V/K115D/R119W/A120V; C73S/F86Y/G104S/S107T/A112V/K115E/R119W/A120V; Q68R/C73S/F86Y/S107T/A112V/K115D/R119Q/A120V; C73R/F86Y/S107T/A112V/K115N/R119Q/A120V; G70E/C73R/F86Y/S107T/A112V/K115N/R119Q/A120V; C73S/F86Y/S107T/A112V/K115D/R119W/A120V; G70E/F86Y/G104T/I106L/S107T/L108T/A112V/K115N/R119L/A120V; C73H/F86Y/A105G/S107T/A112V/K115D/R119L/A120V; G70E/C73P/F86Y/A105C/S107T/A112V/K115D/R119L/A120V; G70E/C73P/F86Y/S107T/A112V/K115D/R119Q/A120V; C73S/F86Y/S107T/K111R/A112V/K115E/R119L/A120V; C73R/D85G/F86Y/A105G/S107T/A112V/K115D/R119Q/A120V; C73R/F86Y/S107T/A112V/K115E/R119W/A120V; N54S/C73G/F86Y/S107T/A112V/K115E/R119Q/A120V; C73S/F86Y/G104S/S107T/A112V/K115N/R119L/A120V; F17L/Q71R/C73G/F86Y/A105G/S107T/A112V/K115D/R119L/A120V; C73G/F86Y/S107T/A112V/K115E/R119W/A120V; G70E/C73G/F86Y/A105C/S107T/A112V/K115E/R119L/A120V; C73G/F86Y/G104A/S107T/A112V/K115D/R119W/A120V; C73S/F86Y/S107T/A112V/K115N/A120V; C73P/F86Y/S107T/A112V/K115N/R119L/A120V; W12R/F86Y/S107T/A112V/K115D/R119Q/A120V; G70E/C73G/F86Y/A105L/A112V/K115N/R119Q/A120V; F86Y/S107T/A112V/K115N/R119W/A120V, with reference to numbering of positions set forth in SEQ ID NO:37.

154. The transmembrane immunomodulatory protein of any of embodiments 130-148, wherein the variant PD-1 polypeptide comprises the amino acid modifications V44H/L45V/N46I/Y48H/M50E/N54G/K58T/L102V/A105V/A112I, with reference to numbering of positions set forth in SEQ ID NO:37.

155. The transmembrane immunomodulatory protein of any of embodiments 130-154, wherein:
the unmodified PD-1 comprises (i) the sequence of amino acids set forth in SEQ ID NO:37, (ii) a sequence of amino acids that has at least 95% sequence identity to SEQ ID NO:37; or (iii) is a portion of (i) or (ii) comprising an IgV domain or specific binding fragment thereof; or
the unmodified PD-1 comprises (i) the sequence of amino acids set forth in SEQ ID NO:392, (ii) a sequence of amino acids that has at least 95% sequence identity to SEQ ID NO:392; or (iii) is a portion of (i) or (ii) comprising an IgV domain or specific binding fragment thereof; or
the unmodified PD-1 comprises (i) the sequence of amino acids set forth in SEQ ID NO:244, (ii) a sequence of amino acids that has at least 95% sequence identity to SEQ ID NO:244; or (iii) is a portion of (i) or (ii) comprising an IgV domain or specific binding fragment thereof.

156. A polynucleotide comprising a sequence of nucleotides encoding the transmembrane immunomodulatory protein of any of embodiments 130-155.

157. The polynucleotide of embodiment 156, further comprising a sequence of nucleotides encoding a recombinant receptor.

158. The polynucleotide of embodiment 157, wherein the recombinant receptor specifically binds to an antigen, optionally wherein the antigen is associated with a disease or condition.

159. The polynucleotide of embodiment 158, wherein the antigen is a tumor antigen or a viral antigen.

160. The polynucleotide of any of embodiments 157-159, wherein the recombinant receptor is a chimeric antigen receptor.

161. The polynucleotide of any of embodiments 157-160, wherein the recombinant receptor is a T cell receptor.

162. The polynucleotide of embodiment 161, wherein the T cell receptor is specific for an HPV antigen, optionally an HPV16 E6 or HPV16 E7.

163. The polynucleotide of any of embodiments 157-162, wherein the sequence of nucleotides encoding the transmembrane immunomodulatory protein and the sequence of nucleotides encoding the recombinant receptor is separated by a self-cleaving peptide or ribosome skip element, optionally T2A or P2A.

164. A vector comprising the polynucleotide of any of embodiments 156-163.

165. The vector of embodiment 164 that is a viral vector, optionally a lentiviral vector.

166. An engineered cell comprising the transmembrane immunomodulatory protein of any of embodiments 130-155, a polynucleotide of any of embodiments 156-163 or a vector of embodiment 164 or embodiment 165.

167. The engineered cell of any of embodiments 127-129 and 166, wherein the cell is an immune cell.

168. The engineered cell of embodiment 167, wherein the immune cell is a lymphocyte.

169. The engineered cell of embodiment 168, wherein the lymphocyte is a T cell.

170. The engineered cell of embodiment 169, wherein the T cell is a CD4+ and/or CD8+ T cell.

171. The engineered cell of embodiment 169 or embodiment 170, wherein the T cell is a regulatory T cell (Treg).

172. The engineered cell of any of embodiments 127-129 and 166-171 that is a primary cell.

173. The engineered cell of any of embodiments 127-129 and 166-172, wherein the cell is a mammalian cell.

174. The engineered cell of any of embodiments 127-129 and 166-173, wherein the cell is a human cell.

175. The engineered cell of any of embodiments 127-129 and 166-174, further comprising a chimeric antigen receptor (CAR).

176. The engineered cell of any of embodiments 127-129 and 166-174, further comprising an engineered T-cell receptor (TCR).

177. An infectious agent, comprising a variant PD-L1 polypeptide of any of embodiments 1-66, an immunomodulatory protein of any of embodiments 67-109, a conjugate that is a fusion protein of any of embodiments 111-114, a nucleic acid molecule of any of embodiments 115-117, a polynucleotide of any of embodiments 156-163, a transmembrane immunomodulatory protein of any of embodiments 130-155, or a vector of any of embodiments 118-120 and 164-165.

178. The infectious agent of embodiment 177, wherein the infectious agent is a bacterium or a virus.

179. The infectious agent of embodiment 178, wherein the infectious agent is a virus and the virus is an oncolytic virus.

180. A pharmaceutical composition, comprising a variant PD-L1 polypeptide of any of embodiments 1-66, an immunomodulatory protein of any of embodiments 67-109, a conjugate that is a fusion protein of any of embodiments 111-114, an engineered cell of any of embodiments 127-129 and 166-176, or an infectious agent of any of embodiments 177-179.

181. The pharmaceutical composition of embodiment 180, comprising a pharmaceutically acceptable excipient.

182. The pharmaceutical composition of embodiment 180 or embodiment 181, wherein the pharmaceutical composition is sterile.

183. An article of manufacture comprising the pharmaceutical composition of any of embodiments 180-182 in a vial or a container.

184. The article of manufacture of embodiment 183, wherein the vial or container is sealed.

185. A kit comprising the pharmaceutical composition of any of embodiments 180-182 or the article of manufacture of embodiment 183 or embodiment 184, and instructions for use.

186. A method of modulating an immune response in a subject, the method comprising administering a variant PD-L1 polypeptide of any of embodiments 1-66, an immunomodulatory protein of any of embodiments 67-109, a conjugate that is a fusion protein of any of embodiments 111-114, an engineered cell of any of embodiments 127-129 and 166-176, an infectious agent of any of embodiments 177-179, or the pharmaceutical composition of any of embodiments 180-182.

187. The method of embodiment 186, comprising administering the immunomodulatory protein of any of embodiments 67-71 to the subject.

188. The method of embodiment 186, comprising administering the immunomodulatory protein of any of embodiments 72-109 to the subject.

189. A method of modulating an immune response in a subject, comprising administering the engineered cells of any of embodiments 127-129 and 166-176.

190. The method of embodiment 189, wherein the engineered cells are autologous to the subject.

191. The method of any of embodiments 186-190, wherein modulating the immune response treats a disease or condition in the subject.

192. The method of any of embodiments 186-191, wherein the immune response is increased.

193. A method of mediating CD28 agonism by PD-L1-dependent CD28 costimulation, comprising administering the immunomodulatory protein of any of embodiments 72-109.

194. The method of embodiment 193, which is for use in treating a disease or condition.

195. The method of any of embodiments 186-194, wherein:
  prior to the administering, selecting a subject for treatment that has a tumor comprising cells positive for surface PD-L1, optionally wherein the cells are tumor cells or tumor infiltrating immune cells; or
  the subject has been selected as having a tumor comprising cells surface positive for PD-L1, optionally wherein the cells are tumor cells or tumor infiltrating immune cells.

196. The method of embodiment 195, wherein selecting a subject comprises:
  (a) contacting a tumor tissue sample from a subject with a binding reagent capable of specifically binding the ectodomain of PD-L1;
  (b) detecting the presence of the bound binding reagent in or on cells of the tumor tissue sample, optionally wherein the cells are tumor cells or tumor infiltrating immune cells; and
  (c) if the tumor tissue sample comprises a detectable level of cells surface positive for PD-L1, selecting the subject for treatment.

197. The method of any of embodiments 188, 193, and 194, wherein:
  prior to the administering, selecting a subject for treatment that has a tumor comprising cells surface positive for CD28, optionally wherein the cells are tumor infiltrating lymphocytes, optionally wherein the lymphocytes are T cells, optionally CD8+ T cells; or
  the subject has been selected as having a tumor comprising cells surface positive for CD28, optionally wherein the cells are tumor infiltrating lymphocytes, optionally wherein the lymphocytes are T cells, optionally CD8+ T cells.

198. The method of embodiment 197, wherein selecting the subject comprises:
  (a) contacting a tumor tissue sample from a subject with a binding reagent capable of specifically binding the ectodomain of CD28;
  (b) detecting the presence of the bound binding reagent in or on cells of the tumor tissue sample, optionally wherein the cells are tumor infiltrating lymphocytes, optionally wherein the lymphocytes are T cells, optionally CD8+ T cells; and (c) if the tumor tissue sample comprises a detectable level of cells surface positive for CD28, selecting the subject for treatment.

199. The method of embodiment 196 or embodiment 198, wherein the tumor tissue sample comprises tumor infiltrating immune cells, tumor cells, stromal cells, or any combination thereof.

200. The method of embodiment 196 or embodiment 198, wherein the binding reagent is an antibody or antigen-binding fragment, protein ligand or binding partner, an aptamer, an affimer, a peptide or a hapten.

201. The method of embodiment 198 or embodiment 200, wherein the binding reagent is an anti-PD-L1 antibody or antigen-binding fragment.

202. The method of any of embodiments 191, 192 and 194-201, wherein the disease or condition is a tumor or cancer.

203. The method of any of embodiments 186-202, wherein the subject has relapsed following remission, has become refractory, or is a non-responder, after treatment with an antagonist of PD-1/PD-L1 or PD-1/PD-L2.

204. The method of embodiment 203, wherein the antagonist is an anti-PD-1 antibody, optionally nivolumab or pembrolizumab.

IX. EXAMPLES

The following examples are included for illustrative purposes only and are not intended to limit the scope of the invention.

Example 1

Generation of Mutant DNA Constructs of IgSF Domains

Example 1 describes the generation of mutant DNA constructs of human PD-1 IgSF domains for translation and expression on the surface of yeast as yeast display libraries.

Constructs were generated based on a wildtype human PD-1 sequence set forth in SEQ ID NO: 37 containing the extracellular domain (corresponding to residues 21-170 as set forth in UniProt Accession No. Q15116), designated "PD-1 (1-150)" as follows:

```
PD-1 (1-150) (SEQ ID NO: 37):
PGWFLDSPDRPWNPPTFSPALLVVTEGDNATFTCSFSNTSESFVLNWYRM

SPSNQTDKLAAFPEDRSQPGQDCRFRVTQLPNGRDFHMSVVRARRNDSGT

YLCGAISLAPKAQIKESLRAELRVTERRAEVPTAHPSPSPRPAGQFQTLV
```

Random DNA libraries were constructed to identify variants of the IgV domain of PD-1 set forth in SEQ ID NO: 37. DNA encoding the wild-type IgV domain was cloned between the BamHI and KpnI sites of a modified pBYDS03 vector (Life Technologies USA), which places PD-1 N-terminal to the anchoring construct, Sag1. After verification of the correct DNA sequence, and that the wild-type protein displays on the yeast surface, the DNA sequence was used as template for error-prone PCR to introduce random mutations at a frequency of 2-5 mutations per gene copy. The Genemorph II Kit (Agilent, USA) was used in combination with titrating amounts of MnCl2 from 0.0 to 0.6 mM to achieve the desired error rate. After error-prone PCR, the mutagenized DNA was gel purified using the NucleoSpin® Gel and PCR Clean-up kit (Macherey-Nagel, Germany). This isolated DNA fragment was then PCR amplified with OneTaq 2×PCR master mix (New England Biolabs, USA) using primers containing 40 bp overlap regions homologous to pBYDS03 for preparation for large scale yeast electroporation. The PD-1 DNA insert (expected size: 530 bp) was gel-purified and resuspended in sterile, deionized water at a nominal concentration of 500 ng/μL.

To prepare the vector for transformation, pBYDS03 was digested with BamHI-HF and KpnI-HF restriction enzymes (New England Biolabs, USA) and the large vector fragment (expected size: 7671 bp) was gel-purified and dissolved in sterile, deionized water at a nominal concentration of 500 ng/μL. To prepare for yeast transformation, 12 μg of library DNA insert was mixed with 4 μg of linearized vector for each electroporation.

Example 2

Introduction of DNA Libraries into Yeast

Example 2 describes the introduction of PD-1 DNA libraries into yeast.

To introduce degenerate and random library DNA into yeast, electroporation-competent cells of yeast strain BJ5464 (ATCC.org; ATCC number 208288) were prepared and electroporated on a Gene Pulser II (Biorad, USA) with the electroporation-ready DNA from the steps above essentially as described elsewhere (Colby, D. W. et al. 200 μL Methods Enzymology 388, 348-358). The only exception is that transformed cells were grown in non-inducing minimal selective SCD-Leu medium to accommodate the LEU2 selective marker carried by modified plasmid pBYDS03. One liter of SCD-Leu media consists of 14.7 grams sodium citrate, 4.29 grams citric acid monohydrate, 20 grams dextrose, 6.7 grams yeast nitrogen base, and 1.6 grams yeast synthetic drop-out media supplement without leucine. The medium was filter sterilized before use using a 0.22 μm vacuum filter device.

Library size was determined by plating serial dilutions of freshly recovered cells on SCD-Leu agar plates and then extrapolating library size from the number of single colonies from plating that generated at least 50 colonies per plate. The remainder of the electroporated culture was grown to saturation and cells from this culture were subcultured 1/100 into the same medium once more and grown to saturation to minimize the fraction of untransformed cells and to allow for segregation of plasmid from cells that may contain two or more library variants. To maintain library diversity, this subculturing step was carried out using an inoculum that contained at least 10× more cells than the calculated library size. Cells from the second saturated culture were resuspended in fresh medium containing sterile 25% (weight/volume) glycerol to a density of 10E10/mL and frozen and stored at −80° C. (frozen library stock).

Example 3

Yeast Selection

Example 3 describes the selection of yeast cells expressing affinity-modified variants of PD-1.

A number of cells equal to at least 10 times the estimated library size were thawed from individual library stocks, suspended to 0.5×10E7 cells/mL in non-inducing SCD-Leu medium, and grown overnight. The next day, a number of cells equal to 10 times the library size were centrifuged at 2000 RPM for two minutes and resuspended to 0.5×10E7 cells/mL in inducing SCDG-Leu media. One liter of SCDG-Leu induction media consists of 5.4 grams $Na_2HPO_4$, 8.56 grams $NaH_2PO_4 \cdot H_2O$, 20 grams galactose, 2.0 grams dextrose, 6.7 grams yeast nitrogen base, and 1.6 grams yeast synthetic drop out media supplement without leucine dissolved in water and sterilized through a 0.22 μm membrane filter device. The culture was grown in induction medium for 1 day at room temperature to induce expression of library proteins on the yeast cell surface.

Cells were sorted once using Protein A magnetic beads (New England Biolabs, USA) loaded with rPD-L1.Fc to reduce non-binders and enrich for all PD-1 variants with the ability to bind their exogenous recombinant counter-structure proteins. This was then followed by several rounds of fluorescence activated cell sorting (FACS) using exogenous counter-structure protein staining to enrich the fraction of yeast cells that displays improved binders. Magnetic bead enrichment and selections by flow cytometry were carried out essentially as described in Miller K. D. et al., Current Protocols in Cytometry 4.7.1-4.7.30, July 2008.

Enrichment was carried out against target ligand proteins human rPD-L1.6×His or rPD-L2.Fc. Magnetic Protein A beads were obtained from New England Biolabs, USA. For two-color, flow cytometric sorting, a Bio-Rad S3e sorter was used. PD-1 yeast display levels were monitored with an anti-hemagglutinin antibody labeled with Alexafluor 488 (Life Technologies, USA). Binding of the counter structure fusion proteins to PD-1 was detected with PE conjugated anti-6×His tag antibody (BioLegend, USA) or PE conjugated human Ig specific goat Fab (Jackson ImmunoResearch, USA). Doublet yeast were gated out using forward scatter (FSC)/side scatter (SSC) parameters, and sort gates were based upon higher ligand binding detected in FL2 that possessed more limited HA tag expression binding in FL1.

Yeast outputs from the flow cytometric sorts were assayed for higher specific binding affinity. Sort output yeast were expanded and re-induced to express the particular IgSF affinity modified domain variants they encode. This population then can be compared to the parental, wild-type yeast strain, or any other selected outputs, such as the bead output yeast population, by flow cytometry.

For PD-1 molecules shown in Table E1 and E2 below, only positive selections to rPD-L1.6×His (i.e., no rPD-L2.Fc negative selections) was performed. For PD-1 molecules shown in Table E3 below, alternating rounds of positive selections to rPD-L1.6×His and negative selections against rPD-L2.Fc were performed to select away from PD-2. Selections were carried out so that the first and last FACS sorts were always positive selections to rPD-L1.6×His. With each positive selection, the rPD-L1.6×His concentration was decreased ~10 fold. Negative selections were always performed with 100 nM rPD-L2.Fc unless stated otherwise. The final FACS outputs were compared to wild-type PD-1 for binding to either rPD-L1.6×His or rPD-L2.Fc by double staining each population with anti-HA (hemagglutinin) tag expression and the anti-human Fc or anti-6×His secondary to detect ligand binding. Exemplary variant PD-1 molecules generated by the method described in Examples 1-3 contain the amino acid substitutions set forth in Table 2. Selected variant PD-1 IgV domains were further formatted as Fc fusion proteins and tested for binding and functional activity as described below.

Example 4

Reformatting Selection Outputs as Fc-Fusions and in Various Immunomodulatory Protein Formats Example 4 describes reformatting of selection outputs identified in Example 3 as immunomodulatory proteins containing an affinity modified (variant) IgV of PD-1 fused to an Fc molecule (variant PD-1 IgV-Fc fusion molecules).

Output cell pools from final flow cytometric PD-1 sorts were grown to terminal density in SCD-Leu medium. Plasmid DNA from final FACS outputs was isolated using a yeast plasmid DNA isolation kit (Zymoresearch, USA). For generation of Fc fusions, the affinity matured PD-1 variants were PCR amplified with primers containing 40 bp homologous regions on either end with the digested Fc fusion vector to carry out in vitro recombination using Gibson Assembly Master Mix (New England Biolabs). After restriction digestion, the PCR products were ligated into Fc fusion vector followed by The Gibson Assembly reaction was added to the E. coli strains XL1 Blue (Agilent, USA) or NEB5alpha (New England Biolabs, USA) for heat shock transformation following the manufacturer's instructions. Exemplary of an Fc fusion vector is pFUSE-hIgG1-Fc2 (Invivogen, USA).

Dilutions of transformation reactions were plated onto LB-agar containing 100 μg/mL carbenicillin (Teknova, USA) to isolate single colonies for selection. Generally, up to 96 colonies from each transformation were then grown in 96 well plates to saturation overnight at 37° C. in LB-broth containing 100 μg/mL carbenicillin (Teknova cat #L8112) and a small aliquot from each well was submitted for DNA sequencing of the PD-1 IgV insert in order to identify mutation(s) in all clones. Sample preparation for DNA sequencing was carried out using protocols provided by the service provider (Genewiz; South Plainfield, NJ). After removal of sample for DNA sequencing, glycerol was then added to the remaining cultures for a final glycerol content of 25% and plates were stored at −20° C. for future use as master plates (see below). Alternatively, samples for DNA sequencing were generated by replica plating from grown liquid cultures to solid agar plates using a disposable 96 well replicator (VWR, USA). These plates were incubated overnight to generate growth patches and the plates were submitted to Genewiz as specified by Genewiz.

After identification of clones of interest from analysis of Genewiz-generated DNA sequencing data, clones of interest were recovered from master plates and individually grown to density in liquid LB-broth containing 100 μg/mL carbenicillin (Teknova, USA) and cultures were then used for preparation of plasmid DNA of each clone using a standard kit such as the PureYield Plasmid Miniprep System (Promega, USA) or the MidiPlus kit (Qiagen). Identification of clones of interest from Genewiz sequencing data generally involved the following steps. First, DNA sequence data files were downloaded from the Genewiz website. All sequences were then manually curated so that they start at the beginning of the ECD domain coding region. The curated sequences were then batch-translated using a suitable program available at the URL: www.ebi.ac.uk/Tools/st/emboss transeq/. The translated sequences were then aligned using a suitable program available at the URL: multalin.toulouse.in-ra.fr/multalin/multalin.html. Alternatively, Genewiz sequences were processed to generate alignments using Ugene software (http://ugene.net).

Clones of interest were then identified from alignments using the following criteria: 1.) identical clone occurs at least two times in the alignment and 2.) a mutation occurs at least two times in the alignment and preferably in distinct clones. Clones that meet at least one of these criteria were assumed to be clones that have been enriched by the sorting process due to improved binding.

To generate recombinant immunomodulatory proteins that are Fc fusion proteins containing an affinity-modified variant of the PD-1 IgV (e.g., variant PD-1 IgV-Fc), the encoding DNA was generated as follows: variant (mutant) PD-1 IgV followed by a linker of 7 amino acids (GSGGGGS) followed by a human IgG1 Fc set forth in SEQ ID NO: 476 containing the mutations L234A, L235E and G237A, by EU numbering. Since the construct does not include any antibody light chains that can form a covalent bond with a cysteine, the human IgG1 Fc also contained replacement of the cysteine residues to a serine residue at position 220 (C220S) by EU numbering (corresponding to position 5 (C5S) with reference to the wild-type or unmodified Fc set forth in SEQ ID NO: 390). The Fc region also lacked the C-terminal lysine at position 447 (designated K447del) by EU numbering (corresponding to position 232 of the wild-type or unmodified Fc) set forth in SEQ ID NO: 390.

```
                                         SEQ ID NO: 476
EPKSSDKTHTCPPCPAPEAEGAPSVFLFPPKPKDTLMISRTPEVTCVVVD

VSHEDPEVKFNWYVDGVEVHNAKTKPREEQYNSTYRVVSVLTVLHQDWLN

GKEYKCKVSNKALPAPIEKTISKAKGQPREPQVYTLPPSRDELTKNQVSL

TCLVKGFYPSDIAVEWESNGQPENNYKTTPPVLDSDGSFFLYSKLTVDKS

RWQQGNVFSCSVMHEALHNHYTQKSLSLSPG
```

Example 5

Expression and Purification of Fc-Fusions

Example 5 describes the high throughput expression and purification of Fc-fusion proteins containing variant IgV PD-1 polypeptides as described in the above Examples.

Recombinant variant Fc fusion proteins were produced from suspension-adapted human embryonic kidney (HEK) 293 cells using the with Expi293 expression system (Invitrogen, USA). 4 μg of each plasmid DNA from the previous step was added to 200 μL Opti-MEM (Invitrogen, USA) at the same time as 10.8 μL ExpiFectamine was separately added to another 200 μL Opti-MEM. After 5 minutes, the 200 μL of plasmid DNA was mixed with the 200 μL of ExpiFectamine and was further incubated for an additional 20 minutes before adding this mixture to cells. Ten million Expi293 cells were dispensed into separate wells of a sterile 10 mL, conical bottom, deep 24 well growth plate (Thomson Instrument Company, USA) in a volume 4 mL Expi293 media (Invitrogen, USA). Plates were shaken for 5 days at 120 RPM in a mammalian cell culture incubator set to 95% humidity and 8% $CO_2$. Following a 5 day incubation, cells were pelleted and culture supernatants were retained.

Proteins were purified from supernatants using a high throughput 96 well Filter Plate (Thomson Catalog number 931919), each well loaded with 60 μL of Mab SelectSure settled bead (GE Healthcare cat. no. 17543801). Protein was eluted with four consecutive 200 μL fractions, of 50 mM Acetate pH3.3. Each fraction's pH was adjusted to above pH 5.0 with 4 μL 2M Tris pH 8.0. Fractions were pooled and quantitated using 280 nm absorbance measured by Nanodrop instrument (Thermo Fisher Scientific, USA), and protein purity was assessed by loading 5 μg of protein on NUPAGE pre-cast, polyacrylamide gels (Life Technologies, USA) under denaturing and non-reducing conditions and subsequent gel electrophoresis. Proteins were visualized in gel using standard Coomassie staining.

Example 6

Assessment of Binding of Affinity-Matured IgSF Domain-Containing Molecules to Cell-Expressed Counter Structure This Example describes Fc-fusion binding studies of purified proteins from the above Examples to assess specificity and affinity of PD-1 domain variant immunomodulatory proteins for a cognate binding partner.

Binding of the PD-1 domain variants described above were assayed for binding to their natural ligands PD-L1 or PD-L2 using Chinese Hamster Ovary (CHO) cells that were transduced to stably express PD-L1 or PD-L2 (CHO/PD-L1 or CHO/PD-L2). For staining by flow cytometry, 100,000 CHO/PD-L1 or CHO/PD-L2 cells were plated in 96 well round bottom plates. Cells were spun down and resuspended in staining buffer (PBS (phosphate buffered saline), 1% BSA (bovine serum albumin), and 0.1% sodium azide) for 20 minutes to block non-specific binding. Afterwards, cells were centrifuged again and resuspended in 50 μL staining buffer containing 100 nM to 46 pM of each candidate PD-1 variant Fc fusion protein. As a control, a variant PD-1 was used that was known to exhibit increased binding to PD-L1 (V44H/L45V/N46I/Y48H/M50E/N54G/K58T/L102V/A105V/A112I; Maude et al., PNAS (2015) 112(47):E6506-E6514). Additional controls included an IgV domain of wild-type PD-1 ("Wt PD-1-Fc"), an anti-PD-L1 antibody (durvalumab; CHO/PD-L1 cells only), an anti-PD-L1 antibody isotype control ("hIgG1"), and an Fc only control. In some experiments, an additional anti-PD-L1 antibody was assayed (atezolizumab) for binding to the CHO/PD-L1 cells. Primary staining was performed on ice for 45 minutes, before washing cells twice in 1504 staining buffer. PE-conjugated anti-human Fc (Jackson ImmunoResearch, USA) was diluted 1:150 in 50 μL staining buffer and added to cells and incubated another 30 minutes on ice. Secondary antibody was washed out twice, cells were fixed in 4% formaldehyde/PBS, and samples were analyzed on either an Intellicyt (Intellicyt Corp., USA) or LSRII (BD Biosciences, Inc., USA) flow cytometer.

Mean Fluorescence Intensity (MFI) was calculated and compared to wildtype PD-1 (1-150) or (6-127)-Fc as control with FlowJo Version 10 (FlowJo Version 10, USA). Results for the binding studies for exemplary tested variant PD-1 IgV-Fc fusion molecules are shown in Tables E1-E3. Tables E1-E3 also indicate amino acid substitutions in the ECD of the variant PD-1 selected in the screening described above. In the Tables, the exemplary amino acid substitutions and insertions in the ECD domain are designated by amino acid position number corresponding to amino acid positions in the respective reference unmodified mature PD-1 extracellular domain (ECD) sequence set forth in SEQ ID NO:37. The amino acid position is indicated in the middle, with the corresponding unmodified (e.g. wild-type) amino acid listed before the number and the identified variant amino acid substitution listed after the number. Column 2 sets forth the SEQ ID NO identifier for each variant IgV domain contained in the variant IgV-Fc fusion molecule.

Also shown is the binding activity as measured by the Mean Fluorescence Intensity (MFI) value for binding of 4 nM of each variant Fc-fusion molecule to CHO/PD-L1 cells (column 3) or CHO/PD-L2 cells (column 5). The concentration of PD-1-Fc that gave a half-maximal MFI response (MFI EC50) or % positive cells (% (+) EC50) was determined, as indicated in columns 4 and 6 for CHO/PD-L1 and CHO/PD-L2 cells, respectively. As shown in Tables E1-E3, the selections resulted in the identification of a number of PD-1 IgSF (e.g. IgV) domain variants that were affinity-modified to exhibit increased binding for PD-L1. The selected variants, in some cases, exhibited altered (increased or decreased) binding to PD-L2.

TABLE E1

Selected PD-1 variants and binding data

| | | Binding to CHO cells | | | |
| --- | --- | --- | --- | --- | --- |
| | | CHO/PD-L1 | | CHO/PD-L2 | |
| PD-1 Mutations | SEQ ID NO | MFI at 4 nM | EC50 [nM] | MFI at 4 nM | EC50 [nM] |
| A112V, R119L, A120V | 103 | 21589 | 10.8 | 49550 | 6.3 |
| N13S, A120V, P142A | 104 | 4212 | 21.9 | 44512 | 11.0 |
| C34Y, N54D, T100S, A112V, A120V | 105 | 118 | 753.7 | 622 | 547.4 |
| M50V, S67N, L80Q, A120V, A143S | 106 | 16231 | 6.6 | 46356 | 5.6 |
| A112V, R119W | 107 | 23359 | 12.1 | 35369 | 24.3 |
| R84H, H87L, A112V, R119W | 108 | 18086 | 14.3 | 29091 | 25.8 |
| Q71R, V91I, A112V, R119L, A120V, T125S | 109 | 21120 | 11.2 | 35556 | 15.3 |
| A112V, K115E | 110 | 15871 | 18.6 | 29267 | 24.0 |
| M50L, L59V, R66H, A112V, H135Y, P138T, P142L | 111 | 26647 | 5.3 | 53848 | 2.7 |
| R119W | 112 | 3111 | 35.1 | 37345 | 9.6 |
| S53G, Q55R, A112V, K115E, A120V, S139T | 113 | 27506 | 4.8 | 21501 | 36.5 |
| R119W, H135R | 114 | 3453 | 27.7 | 35812 | 9.7 |
| A120V, T125I | 115 | 6491 | 15.4 | 47377 | 3.8 |
| A112V, A120V, V131A | 116 | 32677 | 2.5 | 52984 | 6.0 |
| F17I, K111E, A112V, A120V | 117 | 22778 | 6.9 | 44069 | 4.4 |
| S18T, R119Q, R141M | 118 | 1945 | 39.2 | 30664 | 11.5 |
| F36L, S37T, A112V, H135N, P138S | 119 | 9858 | 11.2 | 39646 | 10.0 |
| A112V, T125I | 120 | 30530 | 4.3 | 56521 | 8.0 |
| M50I, A112V, A120V | 121 | 29130 | 4.7 | 53489 | 5.3 |
| S67N, C73R, A93V, A112V, A120V | 122 | 17619 | 13.6 | 47234 | 8.2 |
| D72G, A112V, A120V | 123 | 22782 | 9.6 | 30447 | 22.3 |
| N96D, A112V, A120V, T125S | 124 | 18758 | 13.2 | 22875 | 40.7 |
| F86Y, R119W, T125I | 125 | 27901 | 5.7 | 33099 | 19.0 |
| R119P, T133R | 126 | 1607 | 38.3 | 20752 | 29.8 |
| K111M, A112V, K115E, P132H | 127 | 8205 | 73.6 | 10193 | 167.7 |
| S67G, A112V, T125I, T133S | 128 | 26531 | 6.1 | 52149 | 6.7 |
| A112V, A120V | 129 | 27543 | 6.0 | 48482 | 4.8 |
| S37P, A112V, R119W | 130 | 24704 | 7.7 | 43326 | 11.2 |
| W12L, S37P, A112V, R119W | 131 | 30746 | 4.6 | 50630 | 2.6 |
| A112V, R119L, A120V | 103 | 30090 | 4.6 | 44588 | 7.7 |
| D9G, A112V, A120V | 132 | 33491 | 2.2 | 56777 | 3.8 |
| T31S, S37T, A112V, T125I, A143S | 133 | 23531 | 5.4 | 44040 | 6.3 |
| S37T, A112V, T125I | 134 | 29792 | 4.1 | 64038 | 6.1 |
| R92G, A112V, A120V | 135 | 31072 | 5.0 | 60663 | 5.9 |
| E64D, F86Y, A112V, A120V | 136 | 38782 | 2.3 | 67095 | 3.3 |
| H87R, A112V, R119W | 137 | 27434 | 7.2 | 50513 | 8.6 |
| N13D, A105V, A112V, A120V, A134D | 138 | 30647 | 4.8 | 52091 | 7.3 |
| A112V, R119L, A120V, S137C | 139 | 30016 | 5.8 | 40705 | 6.4 |
| T16I, M50I, A112V, A120V | 140 | 35637 | 1.9 | 51033 | 7.8 |
| M50L, A112V, R119Q, A120V, T125I, H135R | 141 | 36177 | 1.5 | 56182 | 3.3 |
| D57V, A112V | 142 | 31179 | 2.1 | 67219 | 2.4 |
| S67N, R119W | 143 | 11673 | 13.6 | 39540 | 9.7 |
| S67N, A112V, A120V | 144 | 31230 | 5.3 | 57744 | 3.9 |
| N54Y, A112V, P140A | 145 | 27016 | 7.1 | 47479 | 6.8 |
| F43Y, P69L, R119W | 146 | 6027 | 26.6 | 27726 | 13.6 |
| N54Y, A112V, R119W | 147 | 27969 | 5.9 | 40812 | 16.5 |
| A120V | 148 | 6815 | 16.6 | 57679 | 2.6 |
| Wild type PD-1(1-150)-Fc | 37 | 1021 | 77.0 | 55451 | 2.5 |
| V44H, L45V, N46I, Y48H/M50E, N54G, K58T, L102V, A105V, A112I (6-127) | 453 | 30224 | 0.4 | 3099 | 202.8 |
| Wild-type PD-1(6-127) -Fc | 244 | 1211 | 74.4 | 54700 | 1.2 |
| Fc only control | 476 | 43 | N/A | 64 | N/A |
| Anti-PD-L1 antibody | — | 23608 | 1.0 | Not Tested | N/A |
| hIgG1 Isotype Control | — | 350 | N/A | 313 | N/A |

TABLE E2

Additional selected PD-1 variants and binding data

| PD-1 Mutations | SEQ ID NO | Binding to CHO cells: CHO/PD-L1 MFI at 4 nM | CHO/PD-L1 EC50 [nM] | CHO/PD-L2 MFI at 4 nM | CHO/PD-L2 EC50 [nM] |
|---|---|---|---|---|---|
| T56M, C73S, R76H, A112V, R119L, A120V, P132T, R141W | 149 | 121075 | 3.4 | 227100 | 1.3 |
| F17I, S40P, E41D, S67N, R95L, A112V, A120V, T125I, R141M | 150 | 126357 | 3.7 | 187844 | 1.3 |
| F17L, T31S, S35N, P81S, N96S, A112V, R119W | 151 | 4660 | 270.5 | 4533 | 698.6 |
| F43L, S67N, C73R, A112V, A120V | 152 | 106102 | 4.3 | 131119 | 6.8 |
| W12L, N38D, A112V, R119Q, A120V, P142T | 153 | 134806 | 3.0 | 132330 | 1.9 |
| S67N, P69H, C73R, Q79P, V91D, A112V, A120V, P136T, A143D | 154 | 172350 | 2.3 | 183000 | 1.4 |
| F17I, S40P, S67N, Q79R, A112V, R119W, T125I | 155 | 175416 | 1.4 | 239041 | 1.9 |
| F43Y, M50V, S67N, C73R, R92G, A112V, A120V, P136T | 156 | 166660 | 1.5 | 212512 | 4.1 |
| F17L, T56M, S67N, A112V, R119W, A120V, P142R | 157 | 128718 | 4.6 | 147672 | 1.8 |
| W12L, N54Y, S67N, F75Y, V91D, R95L, G104A, A112V, R119W, R141M | 158 | 153382 | 2.5 | 160682 | 0.8 |
| F17L, S37T, S67N, T78S, F86Y, A112V, R119H, A120V, V131E, A143V | 159 | 162551 | 1.8 | 146819 | 0.9 |
| N13D, S40P, A112V, R119L, A120V, S137C | 160 | 156568 | 1.3 | 124389 | 0.9 |
| F17V, A30V, E41V, R76S, A112V, R119Q, A120V, V131A | 161 | 937 | 518.5 | 584 | 632.5 |
| F17I, T25A, M50V, S53T, R66S, S67R, S107T, A112V, R119W, A143V | 162 | 157653 | 1.3 | 98684 | 2.9 |
| N13D, S40P, S67N, C73R, R95L, G104A, A112V, A120V | 163 | 166227 | 1.5 | 111818 | 0.5 |
| S40P, T56A, S67N, C73R, A112V, R119Q, A120V, V131A | 164 | 172431 | 1.1 | 125991 | 0.5 |
| N13Y, S40P, F43L, Q68P, R92G, A112V, R119L, A120V | 165 | 115988 | 5.2 | 690589 | 0.4 |
| F17L, S67N, Q71L, C73S, A112V, R119Q, A120V, P142L | 166 | 121013 | 3.2 | 247042 | 0.7 |
| F17I, S40P, P69S, C73S, N96S, G104A, A112V, A120V | 167 | 120571 | 2.3 | 233404 | 1.7 |
| F17I, S40P, A112V, R119L, A120V, P140R | 168 | 112458 | 3.2 | 186595 | 1.8 |
| A112V, A120V, T133S | 169 | 97884 | 4.6 | 170913 | 3.9 |
| A20S, S67N, C73R, R94Q, A112V, R119Q, A120V, T125I, P132S | 170 | 122444 | 2.9 | 202082 | 2.9 |
| N13D, S67N, C73R, R95L, A112V, R119Q, A120V, T125I | 171 | 146235 | 1.8 | 223838 | 2.1 |
| S40P, S67N, C73R, N96T, A112V, A120V | 172 | 114078 | 2.5 | 226999 | 1.4 |
| L21V, S40P, R95L, G104A, A112V, A120V, A129S, V131A, R141G | 173 | 147808 | 1.8 | 263332 | 1.7 |
| P14S, S40P, S42R, P52A, T56M, A112V, R119W, T125I, P142A | 174 | 129926 | 1.7 | 214607 | 0.8 |
| S40P, F43L, T56A, S67N, C73S, A112V, R119L, A120V | 175 | 151121 | 0.9 | 165743 | 0.7 |
| F17I, S40P, M50V, S67N, C73S, R95L, G104A, A112V, R119L, A120V | 176 | 142477 | 1.2 | 142750 | 0.9 |
| S40P, T56M, C73S, R95L, A112V, R119W, T125I, V131A, R141W | 177 | 127561 | 1.6 | 148744 | 0.8 |
| F17I, A20V, S51G, N54D, F86Y, A112V, A120V, T125I | 178 | 123173 | 1.6 | 133154 | 1.0 |
| F17I, T31N, T56M, S67N, C73R, G104A, A112V, R119Q, A120V, T133A, P140L | 179 | 143091 | 1.3 | 151009 | 0.8 |
| F17V, S40P, R92G, R95L, A112V, R119W | 180 | 159256 | 1.2 | 191263 | 1.7 |
| W12G, F17L, T56V, S67N, A112V, R119W, V131E, R141S | 181 | 154829 | 1.8 | 241699 | 2.2 |
| F86Y, R92G, A112V, R119L, A120V, T125K, T133S | 182 | 142279 | 1.8 | 180530 | 1.4 |

TABLE E2-continued

Additional selected PD-1 variants and binding data

| | | Binding to CHO cells | | | |
|---|---|---|---|---|---|
| | | CHO/PD-L1 | | CHO/PD-L2 | |
| PD-1 Mutations | SEQ ID NO | MFI at 4 nM | EC50 [nM] | MFI at 4 nM | EC50 [nM] |
| P8T, F17I, S67N, F86Y, G104A, A112V, A120V, S139T | 183 | 129938 | 1.9 | 192030 | 5.8 |
| F17I, S40P, A112V, R119W, G144D | 184 | 133560 | 2.5 | 165513 | 5.0 |
| L22I, S67I, G70S, Q71R, S107T, A112V, R119L, A120V, T125I, T133S | 185 | 68384 | 10.3 | 72151 | 5.3 |
| S40P, A112V, A120V | 186 | 127661 | 2.3 | 173666 | 3.1 |
| T16S, S67N, C73R, A112V, R119W | 187 | 110807 | 3.2 | 158530 | 12.7 |
| N13D, S40P, A112V, A120V, T125I, T133S | 188 | 411 | 2.4 | 317 | 2.9 |
| M50L, V91D, A112V, R119W, P132R, R141G | 189 | 65006 | 15.4 | 91944 | 10.0 |
| F17I, S40P, M50I, S67R, A112V, R119L, A120V, S137C | 190 | 162132 | 1.4 | 189467 | 1.5 |
| S40P, A112V, R119W | 191 | 129112 | 1.9 | 158515 | 1.9 |
| F17I, V24L, A112V, R119W | 192 | 53796 | 6.9 | 64107 | 9.1 |
| S40P, S67N, C73R, A93V, A112V, A120V | 193 | 124722 | 1.8 | 174418 | 1.6 |
| N13D, F17I, A112V, R119W, R141M | 194 | 111172 | 2.4 | 144089 | 5.7 |
| S67N, C73R, A112V, A120V, R141S | 195 | 118773 | 2.2 | 171669 | 1.4 |
| A112V, R119L, A120V | 103 | 111269 | 2.7 | 145854 | 1.9 |
| V44H, L45V, N46I, Y48H/M50E, N54G, K58T, L102V, A105V, A112I (6-127) | 453 | 81262 | 1.9 | 941 | 87.0 |
| Wild-type PD-1(6-127)-Fc | 244 | 3701 | 56.0 | 48350.5 | 1.1 |
| Fc only control | 476 | 382 | N/A | 312 | N/A |
| Anti-PD-L1 antibody | — | 95743 | 0.2 | 328 | N/A |
| hIgG1 Isotype Control | — | 350 | N/A | 313 | N/A |

TABLE E3

Additional selected PD-1 variants and binding data

| | | Binding to CHO cells | | | |
|---|---|---|---|---|---|
| | | CHO/PD-L1 | | CHO/PD-L2 | |
| PD-1 Mutations | SEQ ID NO | MFI at 4 nM | EC50 [nM] | MFI at 4 nM | EC50 [nM] |
| W12R, L59V, R66H, F86Y, V90L, A112V, K115N, R119L, A120V | 196 | 80565 | 3.2 | 1606 | 105258.0 |
| F36L, M50I, S51G, C73R, S107T, K111M, A120V, V131E | 197 | 27924 | 9.2 | 66562 | 4.6 |
| M50V, R119W, A120V, T125I, R141G | 198 | 53642 | 4.7 | 47514 | 7.3 |
| A109G, A112V, K115E, R119W | 199 | 78235 | 4.2 | 58296 | 7.7 |
| Q55R, R76H, A112V, K115I, A120V | 200 | 90618 | 2.0 | 24597 | 21.7 |
| W12R, F86Y, R95L, A112V, R119P, T133R | 201 | 142452 | 1.4 | 126074 | 1.2 |
| S67N, C73Y, A112V | 202 | 112719 | 2.1 | 203530 | 0.9 |
| F17I, S40P, T56S, A112V | 203 | 159622 | 0.8 | 211436 | 0.8 |
| W12L, P14S, M50V, S67R, A93V, R94Q, K111T, A112V, R119W, A120V | 204 | 90015 | 3.7 | 60842 | 7.9 |
| F36L, L59R, S67N, A105L, A112V, R119W, A120V, A143V | 205 | 6006 | 204.6 | 4189 | 229.8 |
| L59M, E64K, F86Y, R94Q, A112V, R119L, A120V, T125I, T133S | 206 | 84244 | 3.3 | 51883 | 5.1 |
| P14H, F17Y, T39R, S40T, K58R, V77D, G104V, A112V, Q113R, I114T, A143V | 207 | 342 | N/A | 335 | N/A |
| D57V, L59M, P69S, C73S, A112V, R119L, A120V, A134V | 208 | 112616 | 1.0 | 129528 | 0.5 |

TABLE E3-continued

Additional selected PD-1 variants and binding data

| PD-1 Mutations | SEQ ID NO | Binding to CHO cells | | | |
|---|---|---|---|---|---|
| | | CHO/PD-L1 | | CHO/PD-L2 | |
| | | MFI at 4 nM | EC50 [nM] | MFI at 4 nM | EC50 [nM] |
| V23E, T39S, S40P, C73Y, V91A, R92N, L102F, A112V, R119W, A120V | 209 | 102564 | 3.1 | 173864 | 0.8 |
| T16A, F17I, F36L, S67N, C73R, H87L, R92G, R95L, A112V, R119W | 210 | 119778 | 1.4 | 193830 | 0.6 |
| C73S, A105V, A112V, R119W, A120V, T133A | 211 | 91977 | 3.9 | 181327 | 1.0 |
| P14S, M50L, L59V, R66H, G70S, C73R, A112V, A120V, T125I, G144S | 212 | 120203 | 2.2 | 144124 | 1.3 |
| P8T, S40P, S53N, R95L, A112V, A120V, T125I, R128M, P138T, R141G | 213 | 130316 | 1.4 | 178746 | 0.9 |
| S37T, T56M, C73S, D85N, A109G, A112V, A120V, H135Y, A143S | 214 | 116859 | 1.6 | 190890 | 0.7 |
| S67N, C73R, A93V, G104A, A112V, R119Q, R127S, H135R | 215 | 106834 | 2.4 | 182229 | 0.7 |
| S40P, S67N, C73R, A112V, A120V | 216 | 116572 | 1.5 | 213083 | 0.7 |
| S67N, C73R, A93V, A112V, R119W | 217 | 93090 | 2.5 | 172905 | 1.2 |
| C73R, A93V, A112V, R119W | 218 | 104103 | 1.6 | 188627 | 0.7 |
| S67N, C73R, A112V, A120V | 219 | 127975 | 1.4 | 219557 | 0.7 |
| N13D, P69H, C73R, A93V, A112V, R119W, R141S | 220 | 107303 | 2.2 | 184487 | 0.7 |
| F17I, N38D, S40P, S67N, C73R, A112V, A120V | 221 | 123043 | 1.4 | 218042 | 0.6 |
| N13D, F17I, S40P, T56M, R66S, S67N, G70C, A112V, A120V, R141S | 222 | 126014 | 1.0 | 193906 | 0.6 |
| S40P, F43L, R66S, S67N, G70C, A112V, R119L, A120V | 223 | 83732 | 3.2 | 163202 | 0.9 |
| V23G, S40T, G104A, A112V, R119L, A120V | 224 | 40239 | 9.7 | 93565 | 4.3 |
| W12R, F36I, N54Y, S67I, C73S, A93V, G104A, A112V, K115Q, R119W | 225 | 89381 | 1.6 | 176684 | 0.7 |
| S40P, M50L, S67I, C73S, R92G, A93V, A112V, A120V, R141S | 226 | 120127 | 1.3 | 215950 | 0.4 |
| F17I, T25A, S40P, F43Y, S67N, C73R, F86Y, A112V, R119W, T125I | 227 | 118123 | 1.2 | 204378 | 0.7 |
| F17I, S40P, M50L, S67I, C73S, A112V, A120V, E130K, P136L | 228 | 144849 | 1.6 | 202663 | 0.7 |
| W12R, S40P, S67N, C73R, A93V, A112V, A120V, R141S | 229 | 103188 | 2.2 | 174618 | 1.2 |
| F17I, S40P, M50L, S67I, C73S, R92G, A93V, A112V, A120V, R141S | 230 | 127723 | 1.6 | 167425 | 0.8 |
| F17I, S40P, M50L, S67I, A112V, A120V, R141S | 231 | 115490 | 2.0 | 230226 | 0.6 |
| V23G, T56P, S67I, C73S, F86Y, R92G, G104A, A112V, R119W, A143D | 232 | 120303 | 1.3 | 258735 | 0.5 |
| F17I, S40P, M50L, S67I, C73S, R92G, A93V, A112V, R119W, T125I | 233 | 117164 | 1.6 | 219465 | 1.0 |
| D9V, P11A, N13D, S40T, T56M, S67N, R95L, G104A, A112V, R119L, A120V | 234 | 125434 | 1.2 | 195049 | 0.4 |
| F17I, T25A, S40P, F43Y, S67N, A112V, R119L, A120V | 235 | 101480 | 3.0 | 165041 | 1.5 |
| D9E, F17I, S40P, M50L, S67I, C73S, V90M, T100A, G104A, K111M, A112V, R119W, A120V, A143D | 236 | 135379 | 1.1 | 202270 | 0.9 |
| F17I, S40P, M50L, S67I, C73S, R92G, A93V, A112V, A120V, R141G | 237 | 115048 | 1.1 | 192647 | 0.4 |
| F17I, S40P, S67N, S89G, R95L, A112V, R119W, T125I | 238 | 87327 | 2.1 | 185575 | 0.6 |

TABLE E3-continued

Additional selected PD-1 variants and binding data

| | | Binding to CHO cells | | | |
|---|---|---|---|---|---|
| | | CHO/PD-L1 | | CHO/PD-L2 | |
| PD-1 Mutations | SEQ ID NO | MFI at 4 nM | EC50 [nM] | MFI at 4 nM | EC50 [nM] |
| F17I, S40P, M50L, S67I, C73S, R92G, A93V, K111M, A112V, R119Q, A120V | 239 | 84846 | 1.7 | 179696 | 0.7 |
| D9N, F17I, T31N, S40P, M50L, S67I, C73S, R92G, A93V, A112V, A120V, R141S | 240 | 86715 | 1.2 | 166742 | 0.7 |
| N13D, S40T, T56M, S67N, R95L, G104A, K111R, A112V, A120V, T125I | 241 | 92903 | 0.7 | 179394 | 0.7 |
| W12G, F17I, S40P, M50L, A112V, P132T | 242 | 114691 | 0.9 | 202327 | 0.4 |
| D9N, F17I, S40P, M50T, T56A, G70S, C73R, R92G, A93V, A112V, A120V, R141S | 243 | 127916 | 0.8 | 207427 | 0.4 |
| V44H, L45V, N46I, Y48H/M50E, N54G, K58T, L102V, A105V, A112I (6-127) | 453 | 121598 | 1.4 | 522 | N/A |
| Wild type PD-1 (1-150)-Fc | 37 | 3735 | 57.9 | 128977 | 0.8 |
| Fc Control | 476 | 309 | N/A | 337 | N/A |
| Anti-PD-L1 antibody (atezolizumab) | — | 91412 | 1.2 | 332 | N/A |
| Anti-PD-L1 antibody (durvalumab) | — | 126582 | 0.5 | 316 | N/A |
| hIgG1 Isotype Control | — | 295 | N/A | 327 | N/A |

Example 7

Assessment of Bioactivity of Affinity-Matured IgSF Domain-Containing Molecules Using Jurkat/IL2/PD-1 Reporter Assay This Example describes a Jurkat/IL2/PD-1 reporter assay to assess bioactivity of PD-1 domain variant immunomodulatory proteins for blockade of PD-1/PD-L1.

K562 derived artificial antigen presenting cells (aAPC) cells displaying cell surface anti-CD3 single chain Fv (OKT3) and PD-L1 were brought to $0.67 \times 10^6$ cells/mL in Jurkat Assay buffer (RPMI1640+5% FBS) and 25 μL was added to each well. Variant PD-1 IgV-Fc fusion molecules and control proteins (wildtype PD-1(1-150) or (6-127)-Fc, variant PD-1(6-127)-Fc with V44H/L45V/N46I/Y48H/M50E/N54G/K58T/L102V/A105V/A112I (SEQ ID NO: 453), and an Fc only control) or anti-PD-L1 antibody (durvalumab) were diluted to 200 nM and 25 μL of each protein was added to the plated K562 cells and incubated for 15 minutes at room temperature. Jurkat effector cells expressing an IL-2-luciferase reporter and cell-surfacePD-1 were suspended in Jurkat Assay buffer (RPMI1640+5% FBS) at $2\times10^6$ cells/mL and 2 μg/mL anti-CD28 was added. Jurkat cells were then plated at 50 μL/well for a total of 100,000 cells per well bringing the final volume of each well to 100 μL. Each well had a final ratio of 6:1 Jurkat:K562 cells, 1 μg/mL anti-CD28 and test protein concentration of 50 nM. Jurkat cells and K562 cells were incubated for 5-6 hours at 37 degrees Celsius in a humidified 5% $CO_2$ incubation chamber. Plates were then removed from the incubator and acclimated to room temperature for 15 minutes. 100 μL of a cell lysis and luciferase substrate solution (BioGlo®, Promega Corp, USA) was added to each well and the plates were placed on an orbital shaker for 10 minutes at room temperature. Luminescence was measured with a 1 second per well integration time using a BioTek Cytation luminometer (BioTek Corp., USA).

An average relative luminescence value was determined for each variant PD-1 IgV-Fc and a fold increase in IL-2 reporter signal was calculated for each variant compared to wildtype PD-1 IgV-Fc protein.

As shown in Tables E4-E6, luciferase activity of Jurkat effector cells expressing PD-1 and IL-2-luciferase reporter was increased, following incubation with anti-CD3/PD-L1 aAPC in the presence of select variant PD-1 IgV-Fc molecules. The differences in luminescence values demonstrates binding of variant PD-1 IgV-Fc molecule to PD-L1 and blockade of the interaction of cell-surface PD-1 and PD-L1. Higher values are indicative of increased blockade of PD-L1-mediated inhibition. In the Tables, column 2 sets forth the SEQ ID NO identifier for each variant IgV domain contained in the tested variant PD-1 IgV-Fc fusion molecule.

TABLE E4

| Jurkat/IL2/PD-1 Reporter Assay | | | |
|---|---|---|---|
| PD-1 Mutation(s) | SEQ ID NO | Average Relative Luminescence Units | Fold increase in IL2 reporter signal |
| A112V, R119L, A120V | 103 | 7566 | 3.8 |
| N13S, A120V, P142A | 104 | 3615 | 1.8 |
| C34Y, N54D, T100S, A112V, A120V | 105 | 3412 | 1.7 |
| M50V, S67N, L80Q, A120V, A143S | 106 | 3689 | 1.9 |

TABLE E4-continued

Jurkat/IL2/PD-1 Reporter Assay

| PD-1 Mutation(s) | SEQ ID NO | Average Relative Luminescence Units | Fold increase in IL2 reporter signal |
|---|---|---|---|
| A112V, R119W | 107 | 5073 | 2.6 |
| R84H, H87L, A112V, R119W | 108 | 4608 | 2.3 |
| Q71R, V91I, A112V, R119L, A120V, T125S | 109 | 6048 | 3.1 |
| A112V, K115E | 110 | 4427 | 2.2 |
| M50L, L59V, R66H, A112V, H135Y, P138T, P142L | 111 | 4619 | 2.3 |
| R119W | 112 | 3505 | 1.8 |
| S53G, Q55R, A112V, K115E, A120V, S139T | 113 | 3621 | 1.8 |
| R119W, H135R | 114 | 3729 | 1.9 |
| A120V, T125I | 115 | 3576 | 1.8 |
| A112V, A120V, V131A | 116 | 5593 | 2.8 |
| F17I, K111E, A112V, A120V | 117 | 4235 | 2.1 |
| S18T, R119Q, R141M | 118 | 3280 | 1.7 |
| F36L, S37T, A112V, H135N, P138S | 119 | 3256 | 1.6 |
| A112V, T125I | 120 | 4349 | 2.2 |
| M50I, A112V, A120V | 121 | 6516 | 3.3 |
| S67N, C73R, A93V, A112V, A120V | 122 | 7946 | 4.0 |
| D72G, A112V, A120V | 123 | 4653 | 2.4 |
| N96D, A112V, A120V, T125S | 124 | 4500 | 2.3 |
| F86Y, R119W, T125I | 125 | 4183 | 2.1 |
| R119P, T133R | 126 | 3459 | 1.7 |
| K111M, A112V, K115E, P132H | 127 | 3652 | 1.8 |
| S67G, A112V, T125I, T133S | 128 | 4362 | 2.2 |
| A112V, A120V | 129 | 5378 | 2.7 |
| S37P, A112V, R119W | 130 | 4196 | 2.1 |
| W12L, S37P, A112V, R119W | 131 | 6009 | 3.0 |
| A112V, R119L, A120V | 103 | 6180 | 3.1 |
| D9G, A112V, A120V | 132 | 5646 | 2.9 |
| T31S, S37T, A112V, T125I, A143S | 133 | 4458 | 2.3 |
| S37T, A112V, T125I | 134 | 4171 | 2.1 |
| R92G, A112V, A120V | 135 | 5304 | 2.7 |
| E64D, F86Y, A112V, A120V | 136 | 5978 | 3.0 |
| H87R, A112V, R119W | 137 | 4997 | 2.5 |
| N13D, A105V, A112V, A120V, A134D | 138 | 4246 | 2.1 |
| A112V, R119L, A120V, S137C | 139 | 5940 | 3.0 |
| T16I, M50I, A112V, A120V | 140 | 6615 | 3.3 |
| M50L, A112V, R119Q, A120V, T125I, H135R | 141 | 6776 | 3.4 |
| D57V, A112V | 142 | 3795 | 1.9 |
| S67N, R119W | 143 | 3252 | 1.6 |
| S67N, A112V, A120V | 144 | 6895 | 3.5 |
| N54Y, A112V, P140A | 145 | 3717 | 1.9 |
| F43Y, P69L, R119W | 146 | 3135 | 1.6 |
| N54Y, A112V, R119W | 147 | 4131 | 2.1 |
| A120V | 148 | 3086 | 1.6 |
| Wild type PD-1 (1-150)-Fc | 37 | 3437 | 1.7 |
| V44H, L45V, N46I, Y48H, M50E, N54G, K58T, L102V, A105V, A112I (6-127) | 453 | 7299 | 3.7 |
| Wild-type PD-1 (6-127) -Fc | 244 | 1977 | 1.0 |
| Fc only control | 476 | 3005 | 1.5 |
| Anti-PD-L1 antibody | — | 7992 | 4.0 |

TABLE E5

Jurkat/IL2/PD-1 Reporter Assay

| PD-1 Mutation(s) | SEQ ID NO | Average Relative Luminescence Units | Fold increase in IL2 reporter signal |
|---|---|---|---|
| T56M, C73S, R76H, A112V, R119L, A120V, P132T, R141W | 149 | 6618 | 3.3 |
| F17I, S40P, E41D, S67N, R95L, A112V, A120V, T125I, R141M | 150 | 10667 | 5.4 |
| F17L, T31S, S35N, P81S, N96S, A112V, R119W | 151 | 3550 | 1.8 |

TABLE E5-continued

Jurkat/IL2/PD-1 Reporter Assay

| PD-1 Mutation(s) | SEQ ID NO | Average Relative Luminescence Units | Fold increase in IL2 reporter signal |
|---|---|---|---|
| F43L, S67N, C73R, A112V, A120V | 152 | 4958 | 2.5 |
| W12L, N38D, A112V, R119Q, A120V, P142T | 153 | 5860 | 3.0 |
| S67N, P69H, C73R, Q79P, V91D, A112V, A120V, P136T, A143D | 154 | 8775 | 4.4 |
| F17I, S40P, S67N, Q79R, A112V, R119W, T125I | 155 | 10962 | 5.5 |
| F43Y, M50V, S67N, C73R, R92G, A112V, A120V, P136T | 156 | 8907 | 4.5 |
| F17L, T56M, S67N, A112V, R119W, A120V, P142R | 157 | 8022 | 4.1 |
| W12L, N54Y, S67N, F75Y, V91D, R95L, G104A, A112V, R119W, R141M | 158 | 11963 | 6.1 |
| F17L, S37T, S67N, T78S, F86Y, A112V, R119H, A120V, V131E, A143V | 159 | 9201 | 4.7 |
| N13D, S40P, A112V, R119L, A120V, S137C | 160 | 8741 | 4.4 |
| F17V, A30V, E41V, R76S, A112V, R119Q, A120V, V131A | 161 | 3067 | 1.6 |
| F17I, T25A, M50V, S53T, R66S, S67R, S107T, A112V, R119W, A143V | 162 | 9933 | 5.0 |
| N13D, S40P, S67N, C73R, R95L, G104A, A112V, A120V | 163 | 10018 | 5.1 |
| S40P, T56A, S67N, C73R, A112V, R119Q, A120V, V131A | 164 | 7749 | 3.9 |
| N13Y, S40P, F43L, Q68P, R92G, A112V, R119L, A120V | 165 | 7347 | 3.7 |
| F17L, S67N, Q71L, C73S, A112V, R119Q, A120V, P142L | 166 | 8181 | 4.1 |
| F17I, S40P, P69S, C73S, N96S, G104A, A112V, A120V | 167 | 9493 | 4.8 |
| F17I, S40P, A112V, R119L, A120V, P140R | 168 | 9741 | 4.9 |
| A112V, A120V, T133S | 169 | 4843 | 2.4 |
| A20S, S67N, C73R, R94Q, A112V, R119Q, A120V, T125I, P132S | 170 | 7223 | 3.7 |
| N13D, S67N, C73R, R95L, A112V, R119Q, A120V, T125I | 171 | 7685 | 3.9 |
| S40P, S67N, C73R, N96T, A112V, A120V | 172 | 7700 | 3.9 |
| L21V, S40P, R95L, G104A, A112V, A120V, A129S, V131A, R141G | 173 | 9815 | 5.0 |
| P14S, S40P, S42R, P52A, T56M, A112V, R119W, T125I, P142A | 174 | 6951 | 3.5 |
| S40P, F43L, T56A, S67N, C73S, A112V, R119L, A120V | 175 | 8919 | 4.5 |
| F17I, S40P, M50V, S67N, C73S, R95L, G104A, A112V, R119L, A120V | 176 | 11662 | 5.9 |
| S40P, T56M, C73S, R95L, A112V, R119W, T125I, V131A, R141W | 177 | 5327 | 2.7 |
| F17I, A20V, S51G, N54D, F86Y, A112V, A120V, T125I | 178 | 5873 | 3.0 |
| F17I, T31N, T56M, S67N, C73R, G104A, A112V, R119Q, A120V, T133A, P140L | 179 | 10415 | 5.3 |
| F17V, S40P, R92G, R95L, A112V, R119W | 180 | 10228 | 5.2 |
| W12G, F17L, T56V, S67N, A112V, R119W, V131E, R141S | 181 | 9478 | 4.8 |
| F86Y, R92G, A112V, R119L, A120V, T125K, T133S | 182 | 8439 | 4.3 |
| P8T, F17I, S67N, F86Y, G104A, A112V, A120V, S139T | 183 | 11443 | 5.8 |
| F17I, S40P, A112V, R119W, G144D | 184 | 11468 | 5.8 |
| L22I, S67I, G70S, Q71R, S107T, A112V, R119L, A120V, T125I, T133S | 185 | 6101 | 3.1 |
| S40P, A112V, A120V | 186 | 8790 | 4.4 |
| T16S, S67N, C73R, A112V, R119W | 187 | 5615 | 2.8 |
| N13D, S40P, A112V, A120V, T125I, T133S | 188 | 6216 | 3.1 |
| M50L, V91D, A112V, R119W, P132R, R141G | 189 | 2729 | 1.4 |
| F17I, S40P, M50I, S67R, A112V, R119L, A120V, S137C | 190 | 4651 | 2.4 |

TABLE E5-continued

Jurkat/IL2/PD-1 Reporter Assay

| PD-1 Mutation(s) | SEQ ID NO | Average Relative Luminescence Units | Fold increase in IL2 reporter signal |
|---|---|---|---|
| S40P, A112V, R119W | 191 | 8699 | 4.4 |
| F17I, V24L, A112V, R119W | 192 | 5188 | 2.6 |
| S40P, S67N, C73R, A93V, A112V, A120V | 193 | 4718 | 2.4 |
| N13D, F17I, A112V, R119W, R141M | 194 | 6704 | 3.4 |
| S67N, C73R, A112V, A120V, R141S | 195 | 5402 | 2.7 |
| A112V, R119L, A120V | 103 | 6542 | 3.3 |
| V44H, L45V, N46I, Y48H, M50E, N54G, K58T, L102V, A105V, A112I (6-127) | 453 | 7299 | 3.7 |
| Wild type PD-1 (1-150)-Fc | 37 | 1977 | 1.0 |
| Fc only control | 476 | 3005 | 1.5 |
| Anti-PD-L1 antibody | — | 7992 | 4.0 |

TABLE E6

Jurkat/IL2/PD-1 Reporter Assay

| PD-1 Mutation(s) | SEQ ID NO | Average Relative Luminescence Units | Fold increase in IL2 reporter signal |
|---|---|---|---|
| W12R, L59V, R66H, F86Y, V90L, A112V, K115N, R119L, A120V | 196 | 4349 | 2.7 |
| F36L, M50I, S51G, C73R, S107T, K111M, A120V, V131E | 197 | 1776 | 1.1 |
| M50V, R119W, A120V, T125I, R141G | 198 | 1746 | 1.1 |
| A109G, A112V, K115E, R119W | 199 | 2551 | 1.6 |
| Q55R, R76H, A112V, K115I, A120V | 200 | 1910 | 1.2 |
| W12R, F86Y, R95L, A112V, R119P, T133R | 201 | 4503 | 2.8 |
| S67N, C73Y, A112V | 202 | 3539 | 2.2 |
| F17I, S40P, T56S, A112V | 203 | 5436 | 3.4 |
| W12L, P14S, M50V, S67R, A93V, R94Q, K111T, A112V, R119W, A120V | 204 | 5499 | 3.4 |
| F36L, L59R, S67N, A105L, A112V, R119W, A120V, A143V | 205 | 1965 | 1.2 |
| L59M, E64K, F86Y, R94Q, A112V, R119L, A120V, T125I, T133S | 206 | 6888 | 4.3 |
| P14H, F17Y, T39R, S40T, K58R, V77D, G104V, A112V, Q113R, I114T, A143V | 207 | 2139 | 1.3 |
| D57V, L59M, P69S, C73S, A112V, R119L, A120V, A134V | 208 | 4731 | 2.9 |
| V23E, T39S, S40P, C73Y, V91A, R92N, L102F, A112V, R119W, A120V | 209 | 3319 | 2.1 |
| T16A, F17I, F36L, S67N, C73R, H87L, R92G, R95L, A112V, R119W | 210 | 4830 | 3.0 |
| C73S, A105V, A112V, R119W, A120V, T133A | 211 | 2597 | 1.6 |
| P14S, M50L, L59V, R66H, G70S, C73R, A112V, A120V, T125I, G144S | 212 | 3417 | 2.1 |
| P8T, S40P, S53N, R95L, A112V, A120V, T125I, R128M, P138T, R141G | 213 | 3149 | 1.9 |
| S37T, T56M, C73S, D85N, A109G, A112V, A120V, H135Y, A143S | 214 | 1852 | 1.1 |
| S67N, C73R, A93V, G104A, A112V, R119Q, R127S, H135R | 215 | 4827 | 3.0 |
| S40P, S67N, C73R, A112V, A120V | 216 | 4298 | 2.7 |
| S67N, C73R, A93V, A112V, R119W | 217 | 3698 | 2.3 |
| C73R, A93V, A112V, R119W | 218 | 2973 | 1.8 |
| S67N, C73R, A112V, A120V | 219 | 4412 | 2.7 |
| N13D, P69H, C73R, A93V, A112V, R119W, R141S | 220 | 4206 | 2.6 |
| F17I, N38D, S40P, S67N, C73R, A112V, A120V | 221 | 5751 | 3.6 |
| N13D, F17I, S40P, T56M, R66S, S67N, G70C, A112V, A120V, R141S | 222 | 5911 | 3.7 |
| S40P, F43L, R66S, S67N, G70C, A112V, R119L, A120V | 223 | 5159 | 3.2 |

TABLE E6-continued

Jurkat/IL2/PD-1 Reporter Assay

| PD-1 Mutation(s) | SEQ ID NO | Average Relative Luminescence Units | Fold increase in IL2 reporter signal |
|---|---|---|---|
| V23G, S40T, G104A, A112V, R119L, A120V | 224 | 4951 | 3.1 |
| W12R, F36I, N54Y, S67I, C73S, A93V, G104A, A112V, K115Q, R119W | 225 | 5828 | 3.6 |
| S40P, M50L, S67I, C73S, R92G, A93V, A112V, A120V, R141S | 226 | 5810 | 3.6 |
| F17I, T25A, S40P, F43Y, S67N, C73R, F86Y, A112V, R119W, T125I | 227 | 6404 | 4.0 |
| F17I, S40P, M50L, S67I, C73S, A112V, A120V, E130K, P136L | 228 | 6154 | 3.8 |
| W12R, S40P, S67N, C73R, A93V, A112V, A120V, R141S | 229 | 3715 | 2.3 |
| F17I, S40P, M50L, S67I, C73S, R92G, A93V, A112V, A120V, R141S | 230 | 6034 | 3.7 |
| F17I, S40P, M50L, S67I, A112V, A120V, R141S | 231 | 7334 | 4.5 |
| V23G, T56P, S67I, C73S, F86Y, R92G, G104A, A112V, R119W, A143D | 232 | 5892 | 3.6 |
| F17I, S40P, M50L, S67I, C73S, R92G, A93V, A112V, R119W, T125I | 233 | 5136 | 3.2 |
| D9V, P11A, N13D, S40T, T56M, S67N, R95L, G104A, A112V, R119L, A120V | 234 | 5134 | 3.2 |
| F17I, T25A, S40P, F43Y, S67N, A112V, R119L, A120V | 235 | 5132 | 3.2 |
| D9E, F17I, S40P, M50L, S67I, C73S, V90M, T100A, G104A, K111M, A112V, R119W, A120V, A143D | 236 | 4826 | 3.0 |
| F17I, S40P, M50L, S67I, C73S, R92G, A93V, A112V, A120V, R141G | 237 | 4814 | 3.0 |
| F17I, S40P, S67N, S89G, R95L, A112V, R119W, T125I | 238 | 5119 | 3.2 |
| F17I, S40P, M50L, S67I, C73S, R92G, A93V, K111M, A112V, R119Q, A120V | 239 | 5467 | 3.4 |
| D9N, F17I, T31N, S40P, M50L, S67I, C73S, R92G, A93V, A112V, A120V, R141S | 240 | 5340 | 3.3 |
| N13D, S40T, T56M, S67N, R95L, G104A, K111R, A112V, A120V, T125I | 241 | 4837 | 3.0 |
| W12G, F17I, S40P, M50L, A112V, P132T | 242 | 3880 | 2.4 |
| D9N, F17I, S40P, M50T, T56A, G70S, C73R, R92G, A93V, A112V, A120V, R141S | 243 | 5026 | 3.1 |
| V44H, L45V, N46I, Y48H, M50E, N54G, K58T, L102V, A105V, A112I (6-127) | 453 | 6732 | 4.2 |
| Wild type PD-1 (1-150)-Fc | 37 | 1616 | 1.0 |
| Fc only control | 476 | 2069 | 1.3 |
| Anti-PD-L1 antibody (atezolizumab) | — | 7059 | 4.4 |
| Anti-PD-L1 antibody (durvalumab) | — | 6987 | 4.3 |
| Anti-PD-L1 antibody Isotype Control | — | 1602 | 1.0 |

Example 8

Generation of Variant PD-1 Molecules in Alternative Reference Forms of PD-1

Various additional variant PD-1 polypeptides were generated in alternative reference forms of PD-1. Without wishing to be bound by theory, the alternative forms were generated to reduce or prevent aggregation during production, such as, in some cases, by removing an unstable loop. The alternative reference forms of PD-1 included: (1) a PD-1 IgV containing residues corresponding to amino acids 6-127 of the ECD as set forth in SEQ ID NO: 37, designated "PD-1 (6-127)"; (2) a PD-1 IgV containing residues corresponding to amino acids 13-127 of the ECD as set forth in SEQ ID NO: 37, designated "PD-1 (13-127)"; (3) a modified PD-1 IgV containing residues corresponding to amino acids 6-127 of the ECD and containing a mutation at position C73A, C73R, C73S, L59C, or A60C with reference to positions set forth in SEQ ID NO:37. Table E7 below sets forth various generated reference sequences.

TABLE E7

PD-1 reference sequences

| Reference Sequence | SEQ ID NO | Reference Sequence |
|---|---|---|
| Truncated PD-1 ECD (6-127) | 392 | DSPDRPWNPPTFSPALLVVTEGDNATFTCSFSNTSESFVLNWYRMSPS NQTDKLAAFPEDRSQPGQDCRFRVTQLPNGRDFHMSVVRARRNDSGTY LCGAISLAPKAQIKESLRAELRVTER |
| Truncated PD-1 ECD (13-127) | 457 | NPPTFSPALLVVTEGDNATFTCSFSNTSESFVLNWYRMSPSNQTDKLA AFPEDRSQPGQDCRFRVTQLPNGRDFHMSVVRARRNDSGTYLCGAISL APKAQIKESLRAELRVTER |
| PD-1 (6-127) C73A | 462 | DSPDRPWNPPTFSPALLVVTEGDNATFTCSFSNTSESFVLNWYRMSPS NQTDKLAAFPEDRSQPGQDARFRVTQLPNGRDFHMSVVRARRNDSGTY LCGAISLAPKAQIKESLRAELRVTER |
| PD-1 (6-127) C73R | 645 | DSPDRPWNPPTFSPALLVVTEGDNATFTCSFSNTSESFVLNWYRMSPS NQTDKLAAFPEDRSQPGQDRRFRVTQLPNGRDFHMSVVRARRNDSGTY LCGAISLAPKAQIKESLRAELRVTER |
| PD-1 (6-127) C73S | 646 | DSPDRPWNPPTFSPALLVVTEGDNATFTCSFSNTSESFVLNWYRMSPS NQTDKLAAFPEDRSQPGQDSRFRVTQLPNGRDFHMSVVRARRNDSGTY LCGAISLAPKAQIKELSRAELRVTER |
| PD-1 (6-127) L59C | 464 | DSPDRPWNPPTFSPALLVVTEGDNATFTCSFSNTSESFVLNWYRMSPS NQTDKCAAFPEDRSQPGQDCRFRVTQLPNGRDFHMSVVRARRNDSGTY LCGAISLAPKAQIKESLRAELRVTER |
| PD-1 (6-127) A60C | 469 | DSPDRPWNPPTFSPALLVVTEGDNATFTCSFSNTSESFVLNWYRMSPS NQTDKLCAFPEDRSQPGQDCRFRVTQLPNGRDFHMSVVRARRNDSGTY LCGAISLAPKAQIKESLRAELRVTER |

Exemplary amino acid substitutions from selected PD-1 variants described in Examples above were introduced into the various reference sequences. Table E8A below sets forth generated variant PD-1 molecules.

TABLE E8A

PD-1 variant molecules in reference sequences

| PD-1 Variant Molecule | SEQ ID NO |
|---|---|
| PD-1 (6-127) (SEQ ID NO: 392) | |
| V44H, L45V, N46I, Y48H, M50E, N54G, K58T, L102V, A105V, A112I | 453 |
| F17I, S40P, T56S, A112V | 454 |
| W12R, L59V, R66H, F86Y, V90L, A112V, K115N, R119L, A120V | 455 |
| S40P, A112V, R119W | 456 |
| PD-1 (13-127) (SEQ ID NO: 457) | |
| V44H, L45V, N46I, Y48H, M50E, N54G, K58T, L102V, A105V, A112I | 458 |
| F17I, S40P, T56S, A112V | 459 |
| L59V, R66H, F86Y, V90L, A112V, K115N, R119L, A120V | 460 |
| S40P, A112V, R119W | 461 |
| C73A in PD-1 (6-127) (SEQ ID NO: 462) | |
| V44H, L45V, N46I, Y48H, M50E, N54G, K58T, C73A, L102V, A105V, A112I | 463 |
| L59C in PD-1 (6-127) (SEQ ID NO: 464) | |
| V44H, L45V, N46I, Y48H, M50E, N54G, K58T, L59C, L102V, A105V, A112I | |
| F17I, S40P, T56S, L59C, A112V | 466 |
| W12R, L59C, R66H, F86Y, V90L, A112V, K115N, R119L, A120V | 467 |
| S40P, L59C, A112V, R119W | 468 |

TABLE E8A-continued

PD-1 variant molecules in reference sequences

| PD-1 Variant Molecule | SEQ ID NO |
|---|---|
| A60C in PD-1 (6-127) (SEQ ID NO: 469) | |
| V44H, L45V, N46I, Y48H, M50E, N54G, K58T, A60C, L102V, A105V, A112I | 470 |

The activity of PD-1 variants introduced into the various reference sequences was assessed substantially as described in Example 6 for binding to their natural ligands PD-L1 or PD-L2 using Chinese Hamster Ovary (CHO) cells that were transduced to stably express PD-L1 or PD-L2 (CHO/PD-L1 or CHO/PD-L2). In Table E8B, the binding activity as measured by the Mean Fluorescence Intensity (MFI) value for binding of 4 nM of each variant Fc-fusion molecule to CHO/PD-L1 cells or CHO/PD-L2 cells is shown. In the table, column 2 sets forth the reference sequence of the variants and column 3 sets forth the SEQ ID NO identifier for each variant IgV domain contained in the tested variant PD-1-Fc fusion molecule. The generated molecules of various lengths and additional mutations (e.g., C73A, L59C, or A60C) resulted in variants that, in some cases, exhibited altered (increased or decreased) binding to PD-L1 and PD-L2.

TABLE E8B

PD-1 variant molecules in reference sequences and binding data

| | | | Binding to CHO/PD-L1 and CHO/PD-L2 | |
|---|---|---|---|---|
| PD-1 Mutations | Reference Sequence | SEQ ID NO | PD-L1 MFI at 4 nM | PD-L2 MFI at 4 nM |
| Wildtype | PD-1 (6-127) | 392 | 7231 | 98282 |
| V44H, L45V, N46I, Y48H, M50E, N54G, K58T, L102V, A105V, A112I | PD-1 (6-127) | 453 | 89032 | 1750 |
| F17I, S40P, T56S, A112V | PD-1 (6-127) | 454 | 31675 | 116280 |
| W12R, L59V, R66H, F86Y, V90L, A112V, K115N, R119L, A120V | PD-1 (6-127) | 455 | 38914 | 14875 |
| S40P, A112V, R119W | PD-1 (6-127) | 456 | 38065 | 136912 |
| Wildtype | PD-1 (13-127) | 457 | 9760 | 121576 |
| V44H, L45V, N46I, Y48H, M50E, N54G, K58T, L102V, A105V, A112I | PD-1 (13-127) | 458 | 26825 | 5344 |
| F17I, S40P, T56S, A112V | PD-1 (13-127) | 459 | 33840 | 126486 |
| L59V, R66H, F86Y, V90L, A112V, K115N, R119L, A120V | PD-1 (13-127) | 460 | 62711 | 23516 |
| S40P, A112V, R119W | PD-1 (13-127) | 461 | 41479 | 116568 |
| Wildtype with C73A | PD-1 (6-127) C73A | 462 | 1174 | 92622 |
| V44H, L45V, N46I, Y48H, M50E, N54G, K58T, C73A, L102V, A105V, A112I | PD-1 (6-127) C73A | 463 | 24570 | 3409 |
| Wildtype with L59C | PD-1 (6-127) L59C | 464 | 2639 | 15535 |
| V44H, L45V, N46I, Y48H, M50E, N54G, K58T, L59C, L102V, A105V, A112I | | No Protein Produced | | |
| F17I, S40P, T56S, L59C, A112V | PD-1 (6-127) L59C | 466 | 82672 | 105588 |
| W12R, L59C, R66H, F86Y, V90L, A112V, K115N, R119L, A120V | PD-1 (6-127) L59C | 467 | 20672 | 1194 |
| S40P, L59C, A112V, R119W | PD-1 (6-127) L59C | 468 | 64594 | 65234 |
| Wildtype with A60C | PD-1 (6-127) A60C | 469 | 224 | 13413 |
| V44H, L45V, N46I, Y48H, M50E, N54G, K58T, A60C, L102V, A105V, A112I | PD-1 (6-127) A60C | 470 | 57671 | 249 |
| S40P, A112V, R119W | PD-1 (1-150) | 191 | Not tested | |
| L59V, R66H, F86Y, V90L, A112V, K115N, R119L, A120V | PD-1 (1-150) | 196 | Not tested | |
| F17I, S40P, T56S, L59C, A112V | PD-1 (1-150) | 203 | Not tested | |
| Anti-PDL1 mAb (atezolizumab) | — | — | 96358 | 124 |
| Fc Control | — | — | 646 | 108 |
| Secondary Only | — | — | 112 | 108 |

In addition, a Jurkat/IL2/PD-1 reporter assay substantially as described in Example 7 was used to assess bioactivity of PD-1 domain variant immunomodulatory proteins in various reference sequences for blockade of PD-1/PD-L1. In Table E8C, column 2 sets forth the reference sequence of the variants and column 3 sets forth the SEQ ID NO identifier for each variant IgV domain contained in the tested variant IgV-Fc fusion molecule. As shown in Table E8C, differences in luminescence values were observed showing binding of variant PD-1 IgV-Fc molecule in various reference sequences and with various additional mutations in the reference sequence to PD-L1 and blockade of the interaction of cell-surface PD-1 and PD-L1.

TABLE E8C

| PD-1 variant molecules in reference sequences and binding data | | | | |
|---|---|---|---|---|
| | | | Blockade of PD-1/PD-L1 in Jurkat Assay | |
| PD-1 Mutations | Reference Sequence | SEQ ID NO | RLU at 20 nM | Fold Increase over WT PD-1 |
| Wildtype | PD-1 (6-127) | 392 | 392 | 1.0 |
| V44H, L45V, N46I, Y48H, M50E, N54G, K58T, L102V, A105V, A112I | PD-1 (6-127) | 453 | 1070 | 2.7 |
| F17I, S40P, T56S, A112V | PD-1 (6-127) | 454 | 895 | 2.3 |
| W12R, L59V, R66H, F86Y, V90L, A112V, K115N, R119L, A120V | PD-1 (6-127) | 455 | 1006 | 2.6 |
| S40P, A112V, R119W | PD-1 (6-127) | 456 | 848 | 2.2 |
| Wildtype | PD-1 (13-127) | 457 | 405 | 1.0 |
| V44H, L45V, N46I, Y48H, M50E, N54G, K58T, L102V, A105V, A112I | PD-1 (13-127) | 458 | 1154 | 2.9 |
| F17I, S40P, T56S, A112V | PD-1 (13-127) | 459 | 828 | 2.1 |
| L59V, R66H, F86Y, V90L, A112V, K115N, R119L, A120V | PD-1 (13-127) | 460 | 937 | 2.4 |
| S40P, A112V, R119W | PD-1 (13-127) | 461 | 813 | 2.1 |

TABLE E8C-continued PD-1 variant molecules in reference sequences and binding data

| | | | Blockade of PD-1/PD-L1 in Jurkat Assay | |
|---|---|---|---|---|
| PD-1 Mutations | Reference Sequence | SEQ ID NO | RLU at 20 nM | Fold Increase over WT PD-1 |
| Wildtype with C73A | PD-1 (6-127) C73A | 462 | 339 | 0.9 |
| V44H, L45V, N46I, Y48H, M50E, N54G, K58T, C73A, L102V, A105V, A112I | PD-1 (6-127) C73A | 463 | 1029 | 2.6 |
| Wildtype with L59C | PD-1 (6-127) L59C | 464 | 324 | 0.8 |
| V44H, L45V, N46I, Y48H, M50E, N54G, K58T, L59C, L102V, A105V, A112I | | No Protein Produced | | |
| F17I, S40P, T56S, L59C, A112V | PD-1 (6-127) L59C | 466 | 802 | 2.0 |
| W12R, L59C, R66H, F86Y, V90L, A112V, K115N, R119L, A120V | PD-1 (6-127) L59C | 467 | 333 | 0.8 |
| S40P, L59C, A112V, R119W | PD-1 (6-127) L59C | 468 | 454 | 1.2 |
| Wildtype with A60C | PD-1 (6-127) A60C | 469 | 291 | 0.7 |
| V44H, L45V, N46I, Y48H, M50E, N54G, K58T, A60C, L102V, A105V, A112I | PD-1 (6-127) A60C | 470 | 350 | 0.9 |
| S40P, A112V, R119W | PD-1 (1-150) | 191 | 610 | 1.6 |
| L59V, R66H, F86Y, V90L, A112V, K115N, R119L, A120V | PD-1 (1-150) | 196 | 663 | 1.7 |
| F17I, S40P, T56S, L59C, A112V | PD-1 (1-150) | 203 | 864 | 2.2 |
| Anti-PDL1 mAb (atezolizumab) | — | — | 1127 | 2.9 |
| Fc Control | — | — | 346 | 0.9 |
| hIgG | — | — | 367 | 0.9 |

Example 9

Generation and Selection of Additional Affinity Modified PD-1 Molecules

Additional mutant DNA constructs encoding a variant PD-1 for translation and expression as yeast display libraries were generated substantially as described in Example 1 except the constructs were generated based on the wildtype-human PD-1 sequence set forth in SEQ ID NO: 392 containing a PD-1 (6-127) as provided in Table E7 above.

Target libraries that target specific residues for complete or partial randomization with degenerate codons and/or random libraries were constructed to identify variants of the PD-1 IgV domain. The degenerate or random library DNA was introduced into yeast substantially as described in Example 2 to generate yeast libraries. The libraries were used to select yeast expressing affinity modified variants of PD-1 substantially as described in Example 3. Cells were processed to reduce non-binders and to enrich for PD-1 variants with the ability to bind their exogenous recombinant counter-structure proteins substantially as described in Example 3.

Selection was performed essentially as described in Example 3 above except selection involved positive selection with the desired counter structures PD-L1 followed by negative selection with the counter structure PD-L2 to select away from PD-L2. Additional variants identified in the screen as described are set forth in Table E9A.

The activity of the additional selected PD-1 variants was assessed substantially as described in Example 6 for binding to their natural ligands PD-L1 or PD-L2 using Chinese Hamster Ovary (CHO) cells that were transduced to stably express PD-L1 or PD-L2 (CHO/PD-L1 or CHO/PD-L2). In Tables E9A, the binding activity as measured by the Mean Fluorescence Intensity (MFI) value for binding of 4 nM of each variant Fc-fusion molecule to CHO/PD-L1 cells or CHO/PD-L2 cells is shown. In this table, the tested molecules were observed to exhibit altered (increased or decreased) binding to PD-L1 and PD-L2.

Additionally, a Jurkat/IL2/PD-1 reporter assay substantially as described in Example 7 was used to assess bioactivity of additional selected PD-1 domain variant immunomodulatory proteins for blockade of PD-1/PD-L1. In Table E9B, differences in luminescence values were observed showing binding of the additional selected variant PD-1-Fc molecules to PD-L1 and blockade of the interaction of cell-surface PD-1 and PD-L1. In both tables, column 2 sets forth the reference sequence of the variants and column 3 sets forth the SEQ ID NO identifier for each variant IgV domain contained in the tested variant PD-1-Fc fusion molecule.

TABLE E9A

| Additional PD-1 Variants and Binding Data | | | |
|---|---|---|---|
| | | Binding to CHO/PD-L1 and CHO/PD-L2 | |
| PD-1 Mutations | SEQ ID NO | PD-L1 MFI at 4 nM | PD-L2 MFI at 4 nM |
| N38S, L59M, Q71L, S107T, A112V, K115E, R119Q, A120V | 393 | 54747 | 20961 |
| M50V, L59M, A112V, R119Q, A120V | 394 | 53174 | 56505 |
| P81S, F86Y, R92S, S107T, A112V, K115E, A120V | 395 | 52278 | 62894 |
| C73R, R84Q, F86Y, S107T, A112V, K115D, A120V | 396 | 48843 | 57897 |

TABLE E9A-continued

Additional PD-1 Variants and Binding Data

| | | Binding to CHO/PD-L1 and CHO/PD-L2 | |
|---|---|---|---|
| PD-1 Mutations | SEQ ID NO | PD-L1 MFI at 4 nM | PD-L2 MFI at 4 nM |
| W12G, M50T, S53N, S67R, G70S, C73R, G104V, A112V, K115E, R119W | 397 | 49081 | 60490 |
| T31I, F36Y, F43Y, S67N, G70S, C73R, V90M, A112V, R119W | 398 | 44226 | 42753 |
| R76S, S107T, K111N, A112V, K115N, A120V | 399 | 15171 | 5393 |
| F86Y, A112V, R119W, A120V | 400 | 51647 | 69509 |
| N13S, M50I, R76S, S107T, A112V, K115N, R119W, A120V | 401 | 26573 | 6418 |
| P14H, T16S, M50L, C73R, R84Q, F86Y, S107T, A112V, K115E, A120V | 402 | 46084 | 54218 |
| F17L, T25A, L59M, E64K, F86Y, R94Q, S107T, A112V, K115N, R119W, A120V | 403 | 22237 | 395 |
| Q71R, F86Y, A112V, K115E, R119Q, A120V | 404 | 48607 | 36284 |
| R76S, S107T, A112V, K115N, R119W, A120V | 405 | 16079 | 3046 |
| M50I, A112V, K115D, A120V | 406 | 47443 | 41032 |
| M50V, P81S, F86Y, R92S, S107T, A112V, K115E, A120V | 407 | 46758 | 32253 |
| M50I, S67N, G70R, K111T, A112V, R119W, A120V | 408 | 46195 | 50164 |
| P14H, T16S, M50L, L80Q, K111M, R119Q, A120V | 409 | 39383 | 29377 |
| T31I, F36Y, E64K, A112V, K115E, R119Q, A120V | 410 | 11963 | 4202 |
| S107T, A112V, R119W, A120V | 411 | 55282 | 69678 |
| T56S, A112V, K115E, A120V | 412 | 57756 | 47789 |
| T56S, A112V, R119W | 413 | 54747 | 53174 |
| T56S | 414 | 3462 | 45529 |
| N46I, Y48N, D57Y, S67C, V90L, A112V | 415 | 56919 | 56505 |
| T56S, A112V, R119P | 416 | 57336 | 60638 |
| P14H, F17I, V44M, A112V, K115E, A120V | 417 | 55303 | 65556 |
| Wildtype PD-1 (6-127) Fc | 488 | 7173 | 54350 |
| N38S, T56S, A112V, K115E, A120V | 418 | 51647 | 31945 |
| S42G, M50L, P69S, F86Y, A112V, K115E | 419 | 49200 | 47443 |
| P14H, T56S, A112V, K115E, A120V | 420 | 47328 | 30523 |
| N13S, S67N, G70C, F86Y, S89N, V91D, A112V, R119L, A120V | 421 | 46645 | 51148 |
| W12G, S67N, Q71R, F86Y, K111M, A112V, R119W | 422 | 49921 | 47905 |
| S67N, C73R, V91D, S107T, K111M, A112V, K115Q, R119W | 423 | 52024 | 50043 |
| N13S, M50I, R76S, S107T, K111M, A112V, K115Q, R119W | 424 | 57058 | 50043 |
| T33I, S67N, G70S, S107T, K111N, A112V, K115E, R119W | 425 | 49081 | 34414 |
| P69L, F86Y, V90M, T100I, S107T, K111N, A112V, K115N, A120V | 426 | 52151 | 25217 |
| F17L, T25A, P69L, F86Y, V90M, T100I, S107T, K111N, A112V, K115N, A120V | 427 | 38537 | 6660 |
| T33I, M50I, R76S, F86Y, S107T, A112V, K115N, R119W, A120V | 428 | 48021 | 14550 |
| N13S, S67N, C73R, F86Y, S107T, A112V, Q113R, K115E, A120V | 429 | 50531 | 55552 |
| S67N, C73R, F86Y, V91D, S107T, A112V, K115D, A120V | 430 | 51024 | 33759 |
| F17L, T25A, S67N, C73R, R84Q, F86Y, A93V, A112V, K115E, R119W | 431 | 50653 | 37258 |
| T56S, A112V, K115E | 432 | 51148 | 40540 |
| P69L, V91D, A112V, K115N, R119W, A120V | 433 | 1670 | 279 |
| N13S, E41D, M50I, G70V, D72N, F86Y, R94Q, A112V, R119L, A120V | 434 | 44548 | 44548 |
| M50I, P69L, F86Y, V90M, T100I, S107T, K111N, A112V, K115N, A120V | 435 | 45750 | 15709 |
| M50I, C73R, S107T, K111N, A112V, K115N, A120V | 436 | 45972 | 25763 |
| F86Y, A112V, K115N, R119W | 437 | 40736 | 12845 |
| M50I, S67N, C73R, F86Y, R95L, S107T, A112V, K115N, R119W | 438 | 46532 | 23151 |
| M50L, Q68R, P69S, F86Y, S107T, A112V, K115N, R119W | 439 | 47443 | 18458 |
| N38T, A112V, K115N, R119L, A120V | 440 | 16004 | 6926 |
| S67N, Q71H, F86Y, R95L, S107T, A112V, K115N, R119W | 441 | 54482 | 31489 |
| A20T, D28E, F36L, M50I, Q68R, P69S, F86Y, A112V, R119L, A120V | 442 | 53824 | 55148 |
| M50I, S67N, C73R, F86Y, R95L, A112V, Q113W, R119L, A120V | 443 | 52660 | 50164 |
| L59M, S67N, Q71L, C73R, R95L, S107T, A112V, K115N, R119W | 444 | 52405 | 15491 |
| P52L, S53N, C73S, A112V, E116D, R119W | 445 | 49439 | 39004 |
| Q71R, C73R, A112V, K115N, R119L, A120V | 446 | 53045 | 24742 |
| W12L, A20T, N29D, S37P, L59M, Q68R, P69S, F86Y, A112V, R119L, A120V | 447 | 56643 | 38352 |
| N46I, Y48F, D57V, P69L, A112V, K115N, R119W | 448 | 19529 | 164 |
| M50I, S67N, C73R, F86Y, R95L, S107T, A112V, K115Q, R119Q, A120V | 449 | 44872 | 45972 |
| N54D, P69H, C73R, F86Y, R95L, S107T, A112V, K115N, R119W | 450 | 47099 | 5082 |
| T56S, Q71K, F86Y, R95L, S107T, A112V, K115N, R119W | 451 | 49081 | 4604 |
| V44H, L45V, N46I, Y48H, M50E, N54G, K58T, L102V, A105V, A112I | 489 | 49081 | 2292 |
| Wildtype PD-1 (6-127) Fc | 488 | 5439 | 41032 |
| Atezolizumab | — | 50531 | 108 |
| Fc Control | — | 134 | 100 |

TABLE E9B

Additional PD-1 Variants and Jurkat/IL2/PD-1 Reporter Assay

| | | Blockade of PD-1/PD-L1 in Jurkat Assay | |
|---|---|---|---|
| PD-1 Mutations | SEQ ID NO | RLU at 20 nM | Fold Increase over WT PD-1 |
| N38S, L59M, Q71L, S107T, A112V, K115E, R119Q, A120V | 393 | 2230 | 3.6 |
| M50V, L59M, A112V, R119Q, A120V | 394 | 2418 | 4.0 |
| P81S, F86Y, R92S, S107T, A112V, K115E, A120V | 395 | 2196 | 3.6 |
| C73R, R84Q, F86Y, S107T, A112V, K115D, A120V | 396 | 2352 | 3.8 |
| W12G, M50T, S53N, S67R, G70S, C73R, G104V, A112V, K115E, R119W | 397 | 2194 | 3.6 |
| T31I, F36Y, F43Y, S67N, G70S, C73R, V90M, A112V, R119W | 398 | 1356 | 2.2 |
| R76S, S107T, K111N, A112V, K115N, A120V | 399 | 832 | 1.4 |
| F86Y, A112V, R119W, A120V | 400 | 1738 | 2.8 |
| N13S, M50I, R76S, S107T, A112V, K115N, R119W, A120V | 401 | 1183 | 1.9 |
| P14H, T16S, M50L, C73R, R84Q, F86Y, S107T, A112V, K115E, A120V | 402 | 2050 | 3.4 |
| F17L, T25A, L59M, E64K, F86Y, R94Q, S107T, A112V, K115N, R119W, A120V | 403 | 930 | 1.5 |
| Q71R, F86Y, A112V, K115E, R119Q, A120V | 404 | 2281 | 3.7 |
| R76S, S107T, A112V, K115N, R119W, A120V | 405 | 1083 | 1.8 |
| M50I, A112V, K115D, A120V | 406 | 2336 | 3.8 |
| M50V, P81S, F86Y, R92S, S107T, A112V, K115E, A120V | 407 | 2528 | 4.1 |
| M50I, S67N, G70R, K111T, A112V, R119W, A120V | 408 | 2693 | 4.4 |
| P14H, T16S, M50L, L80Q, K111M, R119Q, A120V | 409 | 737 | 1.2 |
| T31I, F36Y, E64K, A112V, K115E, R119Q, A120V | 410 | 788 | 1.3 |
| S107T, A112V, R119W, A120V | 411 | 2293 | 3.8 |
| T56S, A112V, K115E, A120V | 412 | 1261 | 2.1 |
| T56S, A112V, R119W | 413 | 1056 | 1.7 |
| T56S | 414 | 829 | 1.4 |
| N46I, Y48N, D57Y, S67C, V90L, A112V | 415 | 2250 | 3.7 |
| T56S, A112V, R119P | 416 | 935 | 1.5 |
| P14H, F17I, V44M, A112V, K115E, A120V | 417 | 857 | 1.4 |
| Wildtype PD-1(6-127) Fc | 488 | 834 | 1.4 |
| N38S, T56S, A112V, K115E, A120V | 418 | 991 | 1.6 |
| S42G, M50L, P69S, F86Y, A112V, K115E | 419 | 1737 | 2.8 |
| P14H, T56S, A112V, K115E, A120V | 420 | 955 | 1.6 |
| N13S, S67N, G70C, F86Y, S89N, V91D, A112V, R119L, A120V | 421 | 2012 | 3.3 |
| W12G, S67N, Q71R, F86Y, K111M, A112V, K115Q, R119W | 422 | 2169 | 3.5 |
| S67N, C73R, V91D, S107T, K111M, A112V, K115Q, R119W | 423 | 2246 | 3.7 |
| N13S, M50I, R76S, S107T, K111M, A112V, K115Q, R119W | 424 | 2245 | 3.7 |
| T33I, S67N, G70S, S107T, K111N, A112V, K115E, R119W | 425 | 2319 | 3.8 |
| P69L, F86Y, V90M, T100I, S107T, K111N, A112V, K115N, A120V | 426 | 1719 | 2.8 |
| F17L, T25A, P69L, F86Y, V90M, T100I, S107T, K111N, A112V, K115N, A120V | 427 | 1231 | 2.0 |
| T33I, M50I, R76S, F86Y, S107T, A112V, K115N, R119W, A120V | 428 | 2254 | 3.7 |
| N13S, S67N, C73R, F86Y, S107T, A112V, Q113R, K115E, A120V | 429 | 2439 | 4.0 |
| S67N, C73R, F86Y, V91D, S107T, A112V, K115D, A120V | 430 | 2517 | 4.1 |
| F17L, T25A, S67N, C73R, R84Q, F86Y, A93V, A112V, K115E, R119W | 431 | 2456 | 4.0 |
| T56S, A112V, K115E | 432 | 944 | 1.5 |
| P69L, V91D, A112V, K115N, R119W, A120V | 433 | 828 | 1.4 |
| N13S, E41D, M50I, G70V, D72N, F86Y, R94Q, A112V, R119L, A120V | 434 | 2388 | 3.9 |
| M50I, P69L, F86Y, V90M, T100I, S107T, K111N, A112V, K115N, A120V | 435 | 2493 | 4.1 |
| M50I, C73R, S107T, K111N, A112V, K115N, A120V | 436 | 2308 | 3.8 |
| F86Y, A112V, K115N, R119W | 437 | 1186 | 1.9 |
| M50I, S67N, C73R, F86Y, R95L, S107T, A112V, K115N, R119W | 438 | 2612 | 4.3 |
| M50L, Q68R, P69S, F86Y, S107T, A112V, K115N, R119W | 439 | 2277 | 3.7 |
| N38T, A112V, K115N, R119L, A120V | 440 | 691 | 1.1 |
| S67N, Q71H, F86Y, R95L, S107T, A112V, K115N, R119W | 441 | 1828 | 3.0 |
| A20T, D28E, F36L, M50I, Q68R, P69S, F86Y, A112V, R119L, A120V | 442 | 1786 | 2.9 |
| M50I, S67N, C73R, F86Y, R95L, A112V, Q113W, R119L, A120V | 443 | 1758 | 2.9 |
| L59M, S67N, Q71L, C73R, R95L, S107T, A112V, K115N, R119W | 444 | 1716 | 2.8 |
| P52L, S53N, C73S, A112V, E116D, R119W | 445 | 560 | 0.9 |
| Q71R, C73R, A112V, K115N, R119L, A120V | 446 | 1179 | 1.9 |
| W12L, A20T, N29D, S37P, L59M, Q68R, P69S, F86Y, A112V, R119L, A120V | 447 | 1648 | 2.7 |
| N46I, Y48F, D57V, P69L, A112V, K115N, R119W | 448 | 626 | 1.0 |
| M50I, S67N, C73R, F86Y, R95L, S107T, A112V, K115Q, R119Q, A120V | 449 | 2008 | 3.3 |
| N54D, P69H, C73R, F86Y, R95L, S107T, A112V, K115N, R119W | 450 | 1308 | 2.1 |
| T56S, Q71K, F86Y, R95L, S107T, A112V, K115N, R119W | 451 | 1748 | 2.9 |

TABLE E9B-continued

Additional PD-1 Variants and Jurkat/IL2/PD-1 Reporter Assay

| | | Blockade of PD-1/PD-L1 in Jurkat Assay | |
|---|---|---|---|
| PD-1 Mutations | SEQ ID NO | RLU at 20 nM | Fold Increase over WT PD-1 |
| V44H, L45V, N46I, Y48H, M50E, N54G, K58T, L102V, A105V, A112I | 489 | 2329 | 3.8 |
| Wildtype PD-1(6-127) Fc | 488 | 611 | 1.0 |
| Atezolizumab | — | 2672 | 4.4 |
| Fc Control | — | 677 | 1.1 |

Example 10

Additional Affinity Modified IgSF Domains

This example describes the design, creation, and screening of additional affinity modified immunoglobulin superfamily members ICOSL, CD80 and CD86 for increased binding affinity to binding partners, including for T cell costimulatory molecules such as CD28 or ICOS. Various combinations of ICOSL, CD80, and/or CD86 molecules can be fused in pairs (i.e., stacked) with a variant affinity modified PD-1 to form an immunomodulatory protein with at least dual binding activity for PD-L1 and CD28.

Mutant DNA constructs encoding a variant of the ECD or IgV domain of human ICOSL, CD80, or CD86 for translation and expression as yeast display libraries were generated substantially as described in Example 1. Target libraries that target specific residues for complete or partial randomization with degenerate codons and/or random libraries were constructed to identify variants of the IgSF domains substantially as described in Example 1.

The degenerate or random library DNA was introduced into yeast substantially as described in Example 2 to generate yeast libraries. The libraries were used to select yeast expressing affinity modified variants of ICOSL, CD80, and CD86 substantially as described in Example 3. Cells were processed to reduce non-binders and to enrich for ICOSL, CD80, or CD86 variants with the ability to bind their exogenous recombinant counter-structure proteins substantially as described in Example 3. ICOSL libraries were selected against each of ICOS, CD28, and/or CTLA4. Yeast displayed targeted or random CD80 libraries were selected against each of CD28, CTL-4, and PD-L1, separately. With CD80 and CD86 libraries, target ligand proteins were sourced from R&D Systems (USA) as follows: human rCD28.Fc (i.e., recombinant CD28-Fc fusion protein), rPDL1.Fc, rCTLA4.Fc, and rB7H6.Fc.

Exemplary selection outputs were reformatted as immunomodulatory proteins containing an affinity modified (variant) ECD or IgV of ICOSL, CD80, or CD86, each fused to an Fc molecule substantially as described in Example 4, except that the DNA encoded a fusion protein as follows: variant ECD or IgV domain followed by a linker of three alanines (AAA) followed by a human IgG1 Fc set forth in SEQ ID NO:386 containing the mutations R292C, N297G and V302C by EU numbering (corresponding to R77C, N82G and V87C with reference to wild-type human IgG1 Fc set forth in SEQ ID NO:390). Since the construct does not include any antibody light chains that can form a covalent bond with a cysteine, the human IgG1 Fc also contained replacement of the cysteine residues to a serine residue at position 220 (C220S) by EU numbering (corresponding to position 5 (C5S) with reference to the wild-type or unmodified Fc set forth in SEQ ID NO:390. The Fc-fusion proteins were each expressed and purified substantially as described in Example 5.

Binding of exemplary IgSF domain variants was assessed to cells expressing full-length cognate binding partners substantially as described above in Example 6 using cells expressing cognate binding partners. Flow cytometry were carried out substantially as described in Example 6. In addition, bioactivity of the ICOSL and CD80 variants also was assessed in an anti-CD3 coimmobilization assay or human Mixed Lymphocyte Reaction (MLR) substantially as described in Example 6. For the coimmobilization assay assessing ICOSL variant molecules, costimulatory activity was determined by culture of human T cells with a mixture of 10 nM plate-bound anti-CD3 and 40 nM ICOSL Fc variant proteins. In some cases, the concentration of ICOSL-Fc that gave a half-maximal MFI response (MFI EC50) or % positive cells (% (+) EC50) was determined.

Among the CD86 variants that were identified, was a variant that contained mutations Q35H/H90L/Q102H with reference to positions in the CD86 extracellular domain corresponding to positions set forth in SEQ ID NO:29.

Exemplary selected ICOSL variants and CD80 variants are set forth in Tables E10A-E10F and E11A-E11C, As shown in Tables E10A-E10F and E11A-E11C, the selections resulted in the identification of a number of IgSF domain variants that were affinity-modified to exhibit increased binding for at least one, and in some cases more than one, cognate counter structure ligand. In some cases, some IgSF domain variants with increased binding to CD28 were identified. In addition, the results showed that affinity modification of the variant molecules also exhibited improved activities to both increase and decrease immunological activity depending on the format of the molecule.

As above, for each Table, the exemplary amino acid substitutions are designated by amino acid position number corresponding to the respective reference unmodified ECD sequence (SEQ ID NO: 28 for CD80, SEQ ID NO: 29 for CD86, and SEQ ID NO: 32 for ICOSL). The amino acid position is indicated in the middle, with the corresponding unmodified (e.g. wild-type) amino acid listed before the number and the identified variant amino acid substitution listed after the number. For ICOSL variants with mutations designated with an "X" indicate a Q or the wildtype residue corresponding to the indicated position of SEQ ID NO: 32 at the indicated position. In some cases, the removal of the AAA linker sequence of the variant ICOSL ECD-Fc is indicated by "ΔAAA".

Also shown is the binding activity as measured by the Mean Fluorescence Intensity (MFI) value for binding of each variant Fc-fusion molecule to cells engineered to express the cognate counter structure ligand and the ratio of the MFI compared to the binding of the corresponding unmodified Fc fusion molecule not containing the amino acid substitution(s) to the same cell-expressed counter structure ligand. The functional activity of the variant Fc-fusion molecules to modulate the activity of T cells also is shown based on the calculated levels of IFN-gamma in culture supernatants (pg/mL) generated either i) with the indicated variant Fc fusion molecule coimmoblized with anti-CD3 or ii) with the indicated variant Fc fusion molecule in an MLR assay. The Tables also depict the ratio of IFN-gamma produced by each variant ECD-Fc or IgV-Fc compared to the corresponding unmodified ECD-Fc or IgV-Fc in the functional assays.

TABLE E10A

ICOSL variants selected against CD28 or ICOS.

| | Binding | | Coimmobilization with anti-CD3 | |
|---|---|---|---|---|
| ICOSL mutation(s) | ICOS OD (parental ratio) | CD28 MFI (parental ratio) | IFN-gamma pg/mL (parental ratio) | MLR IFN-gamma levels pg/mL (parental ratio) |
| N52S | 1.33 (1.55) | 162 (9.00) | 1334 (1.93) | 300 (0.44) |
| N52H | 1.30 (1.51) | 368 (20.44) | 1268 (1.83) | 39 (0.06) |
| N52D | 1.59 (1.85) | 130 (7.22) | 1943 (2.80) | 190 (0.28) |
| N52Y/N57Y/F138L/L203P | 1.02 (1.19) | 398 (22.11) | 510* (1.47*) | 18 (0.03) |
| N52H/N57Y/Q100P | 1.57 (1.83) | 447 (24.83) | 2199 (3.18) | 25 (0.04) |
| N52S/Y146C/Y152C | 1.26 (1.47) | 39 (2.17) | 1647 (2.38) | 152 (0.22) |
| N52H/C198R | 1.16 (1.35) | 363 (20.17) | 744* (2.15*) | ND (ND) |
| N52H/C140del/T225A | ND (ND) | 154 (8.56) | 522* (1.51*) | ND (ND) |
| N52H/C198R/T225A | 1.41 (1.64) | 344 (19.11) | 778* (2.25*) | 0 (0) |
| N52H/K92R | 1.48 (1.72) | 347 (19.28) | 288* (0.83*) | 89 (0.13) |
| N52H/S99G | 0.09 (0.10) | 29 (1.61) | 184* (0.53*) | 421 (0.61) |
| N52Y | 0.08 (0.09) | 18 (1.00) | 184* (0.53*) | 568 (0.83) |
| N57Y | 1.40 (1.63) | 101 (5.61) | 580* (1.68*) | 176 (0.26) |
| N57Y/Q100P | 0.62 (0.72) | 285 (15.83) | 301* (0.87*) | 177 (0.26) |
| N52S/S130G/Y152C | 0.16 (0.19) | 24 (1.33) | 266* (0.77*) | 1617 (2.35) |
| N52S/Y152C | 0.18 (0.21) | 29 (1.61) | 238* (0.69*) | 363 (0.53) |
| N52S/C198R | 1.80 (2.09) | 82 (4.56) | 1427 (2.06) | 201 (0.29) |
| N52Y/N57Y/Y152C | 0.08 (0.09) | 56 (3.11) | 377* (1.09*) | 439 (0.64) |
| N52Y/N57Y/H129P/C198R | ND (ND) | 449 (24.94) | 1192 (1.72) | ND (ND) |
| N52H/L161P/C198R | 0.18 (0.21) | 343 (19.05) | 643* (1.86*) | 447 (0.65) |
| N52S/T113E | 1.51 (1.76) | 54 (3.00) | 451* (1.30*) | 345 (0.50) |
| S54A | 1.62 (1.88) | 48 (2.67) | 386* (1.12*) | 771 (1.12) |
| N52D/S54P | 1.50 (1.74) | 38 (2.11) | 476* (1.38*) | 227 (0.33) |
| N52K/L208P | 1.91 (2.22) | 291 (16.17) | 1509 (2.18) | 137 (0.20) |
| N52S/Y152H | 0.85 (0.99) | 68 (3.78) | 2158 (3.12) | 221 (0.32) |
| N52D/V151A | 0.90 (1.05) | 19 (1.06) | 341* (0.99*) | 450 (0.66) |
| N52H/I143T | 1.83 (2.13) | 350 (19.44) | 2216 (3.20) | 112 (0.16) |
| N52S/L80P | 0.09 (0.10) | 22 (1.22) | 192* (0.55*) | 340 (0.49) |
| F120S/Y152H/N201S | 0.63 (0.73) | 16 (0.89) | 351* (1.01*) | 712 (1.04) |
| N52S/R75Q/L203P | 1.71 (1.99) | 12 (0.67) | 1996 (2.88) | 136 (0.20) |
| N52S/D158G | 1.33 (1.55) | 39 (2.17) | 325* (0.94*) | 277 (0.40) |
| N52D/Q133H | 1.53 (1.78) | 104 (5.78) | 365* (1.05*) | 178 (0.26) |
| WT ICOSL | 0.86 (1.00) | 18 (1.00) | 692/346* (1.00) | 687 (1.00) |

Molecule sequences, binding data, and costimulatory bioactivity data.

TABLE E10B

ICOSL variants: binding data and costimulatory bioactivity data.

| ICOSL mutation(s) | ICOS tfxn MFI (parental ratio) | CD28 tfxn MFI (parental ratio) | CTLA-4 tfxn MFI (parental ratio) | Anti-CD3 IFN-gamma Coimmobilization Assay pg/mL (parental ratio) | MLR IFN-gamma pg/mL (parental ratio) |
|---|---|---|---|---|---|
| N52H, F78L, Q100R, C198R | 9568 (0.12) | 1966 (0.24) | 1454 (0.12) | 130 (0.31) | 5927 (1.84) |
| N52H, N57Y, Q100R, V110D, C198R, S212G | 9418 (1.16) | 136665 (16.55) | 115352 (9.59) | 944 (2.21) | 821 (0.25) |
| N52H, N57Y, R75Q, Q100P, V110D | 5558 (0.07) | 7465 (0.90) | 4689 (0.39) | 122 (0.28) | 1136 (0.35) |
| N52H, N57Y, Q100R, C198R | 9148 (1.13) | 134923 (16.33) | 83241 (6.92) | 1060 (2.48) | 375 (0.12) |
| N52H, N57Y, L74Q, V110D, S192G | 9448 (1.17) | 128342 (15.54) | 123510 (10.26) | 1137 (2.66) | 889 (0.28) |

TABLE E10B-continued

ICOSL variants: binding data and costimulatory bioactivity data.

| ICOSL mutation(s) | ICOS tfxn MFI (parental ratio) | CD28 tfxn MFI (parental ratio) | CTLA-4 tfxn MFI (parental ratio) | Anti-CD3 IFN-gamma Coimmobilization Assay pg/mL (parental ratio) | MLR IFN-gamma pg/mL (parental ratio) |
|---|---|---|---|---|---|
| N52H, Q100R | 9478 (1.17) | 151977 (18.40) | 133929 (11.13) | 972 (2.28) | 794 (0.25) |
| N52H, S121G, C198R | 9128 (1.13) | 124732 (15.10) | 182607 (15.18) | 827 (1.94) | 1257 (0.39) |
| A20V, N52H, N57Y, Q100R, S109G | 5828 (0.72) | 76973 (9.32) | 73640 (6.12) | 447 (1.05) | 2283 (0.71) |
| N52H, N57Y, Q100P, C198R | 9548 (1.18) | 130676 (15.82) | 81966 (6.81) | 1125 (2.64) | 643 (0.20) |
| N52H, N57Y, R61S, Q100R, V110D, L173S | 1018 (0.13) | 9129 (1.11) | 5790 (0.48) | 109 (0.25) | 5094 (1.58) |
| N52H, N57Y, Q100R, V122A | 9978 (1.23) | 137372 (16.63) | 70764 (5.88) | 1316 (3.08) | 473 (0.15) |
| N52H, N57Y, Q100R, F172S | 1028 (1.27) | 135821 (16.44) | 77320 (6.09) | 1561 (3.66) | 486 (0.15) |
| N52H, N57Y, Q100R | 9858 (1.22) | 140612 (17.02) | 75106 (6.24) | 1648 (3.86) | 778 (0.24) |
| N52S, F120S, N227K | 9438 (1.17) | 67796 (8.21) | 82370 (6.85) | 1157 (2.71) | 1626 (0.50) |
| N52S, N194D | 9798 (1.21) | 59431 (7.19) | 74502 (6.19) | 1671 (3.91) | 1690 (0.52) |
| N52S, V97A | 3138 (0.04) | 1733 (0.21) | 1541 (0.13) | 84 (0.20) | 3858 (1.20) |
| N52S, F120S | 9068 (1.12) | 67233 (8.14) | 97880 (8.13) | 1178 (2.76) | 2814 (0.87) |
| N52S, G72R | 9288 (1.15) | 51638 (6.25) | 62339 (5.18) | 1161 (2.72) | 2947 (0.91) |
| N52S, A71T, A117T, T190A, C198R | 8918 (1.10) | 44044 (5.33) | 56646 (4.71) | 1076 (2.52) | 4031 (1.25) |
| N52S, E220G | 3878 (0.05) | 2047 (0.25) | 1796 (0.15) | 122 (0.29) | 1927 (0.60) |
| Y47H, N52S, V107A, F120S | 3268 (0.04) | 2562 (0.31) | 2104 (0.17) | 334 (0.78) | 4390 (1.36) |
| WT ICOSL | 8088 (1.00) | 8260 (1.00) | 12033 (1.00) | 427 (1.00) | 3226 (1.00) |
| T43A, N52H, N57Y, L74Q, D89G, V110D, F172S | 2821 (0.02) | 2180 (0.49) | 2051 (0.12) | 184 (0.75) | |
| N52H, N57Y, Q100R, V107I, V110D, S132F, I154F, C198R, R221G | 174586 (0.97) | 122383 (27.24) | 76202 (4.31) | 985 (4.01) | 1037 (0.36) |
| E16V, N52H, N57Y, Q100R, V110D, H115R, Y152C, K156M, C198R | 190765 (1.05) | 129070 (28.73) | 68488 (3.87) | 4288 (17.46) | 1225 (0.43) |
| Q37R, N52H, N57Y, Q100R, V110N, S142F, C198R, D217V, R221G | 148638 (0.82) | 91104 (20.28) | 13498 (0.76) | 62 (0.25) | 7643 (2.68) |
| N52H, N57Y, Q100R, V110D, C198R | 179194 (0.99) | 123312 (27.45) | 84136 (4.76) | 762 (3.10) | 1342 (0.47) |
| N52H, N57Y, Q100R, V110D, V116A, L161M, F172S, S192G, C198R | 5236 (0.03) | 4160 (0.93) | 3305 (0.19) | 49 (0.20) | 2039 (0.72) |
| F27S, N52H, N57Y, V110N | 20154 (0.11) | 8613 (1.92) | 3903 (0.22) | 83 (0.34) | 7522 (2.64) |
| F27S, N52H, N57Y, V110N | 5236 (0.03) | 4160 (0.93) | 2957 (0.17) | 40 (0.16) | — |
| N52S, H94E, L96I, S109N, L166Q | 198604 (1.10) | 100361 (22.34) | 102892 (5.82) | 1253 (5.10) | 5645 (1.98) |
| S18R, N52S, F93L, I143V, R221G | 154561 (0.85) | 7625 (1.70) | 4254 (0.24) | 203 (0.83) | 5239 (1.84) |
| A20T, N52D, Y146C, Q164L | 149661 (0.83) | 9073 (2.02) | 6901 (0.39) | 287 (1.17) | 4829 (1.69) |
| V11E, N30D, N52H, N57Y, H94E, L96I, L98F, N194D, V210A, I218T | 180016 (1.00) | 120230 (26.76) | 62809 (3.55) | 2218 (9.03) | 7283 (2.56) |
| N52S, H94E, L96I, V122M | 198717 (1.10) | 88901 (19.79) | 94231 (5.33) | 590 (2.40) | 618 (0.22) |
| N52H, N57Y, H94E, L96I, F120I, S126T, W153R, I218N | 87711 (0.48) | 42035 (9.36) | 31798 (1.80) | 67 (0.27) | 2500 (0.88) |
| M10V, S18R, N30D, N52S, S126R, T139S, L203F | 180665 (1.00) | 64929 (14.45) | 48362 (2.73) | 1193 (4.86) | 13647 (4.79) |
| S25G, N30D, N52S, F120S, N227K | 178834 (0.99) | 66127 (14.72) | 46631 (2.64) | 1246 (5.07) | 2202 (0.77) |
| N30D, N52S, L67P, Q100K, D217G, R221K, T225S | 18630 (0.10) | 1986 (0.44) | 1940 (0.11) | 54 (0.22) | 2752 (0.97) |
| WT ICOSL | 180900 (1.00) | 4493 (1.00) | 17685 (1.00) | 246 (1.00) | 2850 (1.00) |
| N52H, N57Y, Q100R, V110D, A117T, T190S, C198R | 2831 (0.04) | 2881 (0.57) | 2464 (0.23) | 59 (0.08) | — |
| N52H, N57Y, Q100R, V110D, F172S, C198R | 58478 (0.79) | 74031 (14.75) | 56850 (5.33) | 712 (0.96) | 1093 (0.23) |
| S25G, F27C, N52H, N57Y, Q100R, V110D, E135K, L173S, C198R | 22514 (0.30) | 21320 (4.25) | 20450 (1.92) | 353 (0.48) | 5765 (1.21) |
| N52H, N57Y, V110A, C198R, R221I | 84236 (1.14) | 81842 (16.31) | 121519 (11.39) | 4593 (6.18) | 1137 (0.24) |
| M10I, S13G, N52H, N57Y, D77G, V110A, H129P, I143V, F172S, V193M, C198R | 6362 (0.09) | 6001 (1.20) | 4834 (0.45) | 141 (0.19) | 4326 (0.91) |
| N52H, N57Y, R61C, Y62F, Q100R, V110N, F120S, C198R | 4355 (0.06) | 4316 (0.86) | 3430 (0.32) | 110 (0.15) | 6854 (1.44) |
| N52H, N57Y, Q100R, L102R, V110D, H115R, C198R | 96736 (1.31) | 77881 (15.52) | 148012 (13.88) | 8765 (11.79) | 630 (0.13) |
| N52H, N57Y, Q100R, V110D, N144D, F172S, C198R | 67578 (0.91) | 64953 (12.94) | 95731 (8.98) | 1672 (2.52) | 1490 (0.31) |

TABLE E10B-continued

ICOSL variants: binding data and costimulatory bioactivity data.

| ICOSL mutation(s) | ICOS tfxn MFI (parental ratio) | CD28 tfxn MFI (parental ratio) | CTLA-4 tfxn MFI (parental ratio) | Anti-CD3 IFN-gamma Coimmobilization Assay pg/mL (parental ratio) | MLR IFN-gamma pg/mL (parental ratio) |
|---|---|---|---|---|---|
| N52S, H94E, L98F, Q100R | 80690 (1.09) | 78750 (15.69) | 148160 (13.89) | 3564 (4.80) | 1497 (0.32) |
| N52S, E90A | 108908 (1.47) | 31086 (6.19) | 108866 (10.21) | 4564 (6.14) | 3927 (0.83) |
| N30D, K42E, N52S | 85726 (1.16) | 4293 (0.86) | 10755 (1.01) | 5211 (7.01) | 5656 (1.19) |
| N52S, F120S, I143V, I224V | 90862 (1.23) | 28443 (5.67) | 105229 (9.87) | 4803 (6.46) | 4357 (0.92) |
| WT ICOSL | 73964 (1.00) | 5018 (1.00) | 10665 (1.00) | 743 (1.00) | 4748 (1.00) |

TABLE E10C

Flow Cytometric EC50s for ICOSL variants

| ICOSL mutation(s) | CD28 MFI EC50 [pM] | CD28 % (+) EC50 [pM] | CTLA-4 MFI EC50 [pM] | CTLA-4 % (+) EC50 [pM] | ICOS MFI EC50 [pM] | ICOS % (+) EC50 [pM] |
|---|---|---|---|---|---|---|
| WT ICOSL | 1000000 | 1000000 | 1000000 | 1000000 | 10543 | 762 |
| N52H, I143T | 19147 | 567 | 20259 | 1891 | 2666 | 286 |
| N52H, N57Y, Q100R, C198R | 950 | 159 | 73548 | 422 | 1032 | 179 |
| N52H, N57Y, Q100R, V122A | 29701 | 152 | 1008 | 293 | 302 | 64 |
| N52H, N57Y, Q100R, F172S | 1006 | 231 | 1332 | 396 | 779 | 130 |
| N52Y/N57Y/F138L/L203P | 7844 | 386 | 7457 | 994 | 3104 | 408 |
| V11E, N30D, N52H, N57Y, H94E, L96I, L98F, N194D, V210A, I218T | 5961 | 595 | 6909 | 1026 | 5514 | 852 |
| N52H, N57Y, Q100R, L102R, V110D, H115R, C198R | 1034 | 307 | 23328 | 579 | 3172 | 347 |
| N52H, N57Y, Q100R | 1665 | 238 | 11002 | 533 | 383 | 131 |
| N52H, Q100R | 1305 | 274 | 8593 | 1997 | 702 | 167 |
| N52H, N57Y, Q100R, V110D, C198R, S212G | 4987 | 594 | 30

TABLE E10D-continued

Molecule sequences, binding data, and costimulatory bioactivity data of variant ICOSLECD-Fc molecules containing select mutations

| ICOSL Mutations | Binding | | | Coimmobilization with anti-CD3 |
|---|---|---|---|---|
| | ICOS MFI (parental ratio) | CD28 MFI (parental ratio) | CTLA-4 MFI (parental ratio) | IFN-gamma pg/mL (parental ratio) |
| N52H, Q100R, C198R | 111428 (1.26) | 58608 (29.08) | 116111 (26.71) | 3729 (27.94) |
| N52H, Q100R, H115R, F172S | 105532 (1.19) | 58287 (28.92) | 106295 (24.45) | 5

TABLE E10E-continued

Molecule sequences, binding data, and costimulatory bioactivity data of variant ICOSLECD-Fc molecules containing select mutations

| ICOSL Mutations | Binding | | | Coimmobilization with anti-CD3 |
|---|---|---|---|---|
| | ICOS MFI (parental ratio) | CD28 MFI (parental ratio) | CTLA-4 MFI (parental ratio) | IFN-gamma pg/mL (parental ratio) |
| N30D, K42E, N52S, H115R, C198R | 161734 (1.93) | 2791 (0.53) | 2919 (0.61) | 841 (2.92) |
| N30D, K42E, N52S, H115R, F172S, N194D | 117880 (1.41) | 4395 (0.84) | 4941 (1.04) | 2904 (10.09) |
| N30D, K42E, N52S, H115R, | 114107 (1.36) | 2935 (0.56) | 2748 (0.58) | 549 (1.91) |
| N52S, E90A, H115R, | 120450 (1.44) | 12768 (2.45) | 23282 (4.88) | 2890 (10.04) |
| N30D, K42E, N52S, H115R | 115273 (1.38) | 11964 (2.29) | 22779 (4.77) | 2241 (7.79) |
| N52S, H115R, F172S, C198R | 95537 (1.14) | 7614 (1.46) | 21701 (4.55) | 1458 (5.07) |
| Wildtype | 83813 (1.00) | 5222 (1.00) | 4772 (1.00) | 288 (1.00) |

TABLE E10F

Molecule sequences, binding data, and costimulatory bioactivity data of variant ICOSLECD-Fc molecules containing glycosylation mutations

| ICOSL Mutation(s) | Binding | | | Coimmobilization with anti-CD3 |
|---|---|---|---|---|
| | ICOS MFI (parental ratio) | CD28 MFI (parental ratio) | CTLA-4 MFI (parental ratio) | IFN-gamma pg/mL (parental ratio) |
| N84Q | 34426 (0.94) | 1755 (1.16) | 5757 (1.51) | 100 (2.03) |
| N119Q | 30806 (0.84) | 4102 (2.70) | 19836 (5.21) | 81 (1.66) |
| N168Q | 27041 (0.74) | 1410 (0.93) | 18641 (4.90) | 67 (1.36) |
| N207Q | 36516 (1.00) | 11923 (7.86) | 25701 (6.76) | 206 (4.20) |
| N52Q, N207X | 30216 (0.83) | 12086 (7.97) | 27952 (7.35) | 77 (1.56) |
| N168X, N207X | 37191 (1.02) | 5787 (3.81) | 12280 (3.23) | 104 (2.12) |
| N52Q, N168Q | 32576 (0.89) | 12638 (8.33) | 27167 (7.14) | 101 (2.06) |
| N84Q, N207Q | 37176 (1.02) | 5292 (3.49) | 3153 (0.83) | 31 (0.63) |
| N155Q, N207Q | 34884 (0.95) | 1489 (0.98) | 987 (0.26) | 73 (1.48) |
| N119Q, N168Q | 29099 (0.80) | 2534 (1.67) | 11289 (2.97) | 51 (1.05) |
| N119Q, N207Q | 32603 (0.89) | 1861 (1.23) | 6795 (1.79) | 153 (3.12) |
| N119Q N155X | 38516 (1.05) | 15318 (10.10) | 27498 (7.23) | 173 (3.52) |
| N52Q, N84Q | 33988 (0.93) | 1675 (1.10) | 3525 (0.93) | 39 (0.80) |
| N52Q, N119Q | 35729 (0.98) | 11040 (7.28) | 26139 (6.87) | 51 (1.03) |
| N84Q, N119Q | 34777 (0.95) | 1493 (0.98) | 2877 (0.76) | 39 (0.80) |
| N52Q, N84Q, N168Q | 27021 (0.74) | 1584 (1.04) | 958 (0.25) | 38 (0.78) |
| N52Q, N84Q, N207Q | 39942 (1.09) | 13396 (8.83) | 26360 (6.93) | 37 (0.76) |
| N84Q, N155Q, N168Q | 27812 (0.76) | 357 (0.24) | 466 (0.12) | 30 (0.61) |
| N84Q, N168Q, N207Q | 30659 (0.84) | 737 (0.49) | 861 (0.23) | 25 (0.52) |
| N84Q, N155H, N207Q | 13557 (0.37) | 685 (0.45) | 607 (0.16) | 29 (0.59) |
| N155Q, N168Q, N207Q | 13999 (0.38) | 277 (0.18) | 317 (0.08) | 40 (0.82) |
| N119Q, N155Q, N168Q | 36896 (1.01) | 4094 (2.70) | 2179 (0.57) | 50 (1.02) |
| N119Q, N168Q, N207Q | 29543 (0.81) | 921 (0.61) | 3744 (0.98) | 72 (1.47) |
| N84Q, N119Q, N207Q | 21357 (0.58) | 569 (0.38) | 640 (0.17) | 59 (1.20) |
| N119Q, N155H, N207Q | 37310 (1.02) | 614 (0.40) | 931 (0.24) | 86 (1.75) |
| N84Q, N119Q, N155Q | 2675 (0.07) | 262 (0.17) | 291 (0.08) | 34 (0.70) |
| N52Q, N119Q, N155Q | 27853 (0.76) | 552 (0.36) | 772 (0.20) | 42 (0.87) |
| N52H, N84Q, N119Q | 40700 (1.11) | 4580 (3.02) | 4601 (1.21) | 39 (0.80) |
| N52H, N84Q, N168X, N207X | 8796 (0.24) | 587 (0.39) | 481 (0.13) | 32 (0.66) |
| N52Q, N84Q, N155X, N168X | 43521 (1.19) | 6605 (4.35) | 4811 (1.26) | 32 (0.66) |
| N52Q, N84Q, N119Q, N168Q | 39342 (1.07) | 4519 (2.98) | 3300 (0.87) | 37 (0.76) |
| N52Q, N84Q, N119Q, N207Q | 7011 (0.19) | 602 (0.40) | 433 (0.11) | 37 (0.75) |
| Wildtype ICOSL ECD | 36602 (1.00) | 1517 (1.00) | 3804 (1.00) | 49 (1.00) |

TABLE E11A

CD80 variants selected against CD28.

| CD80 mutation(s) | Binding CD28 MFI (parental ratio) | CTLA-4 MFI (parental ratio) | PD-L1 MFI (parental ratio) | Coimmobilization with anti-CD3 IFN-gamma pg/mL (parental ratio) | MLR IFN-gamma levels pg/mL (parental ratio) |
|---|---|---|---|---|---|
| L70Q/A91G/N144D | 125 (1.31) | 283 (1.36) | 6 (0.08) | 93 (1.12) | 716 (0.83) |
| L70Q/A91G/T130A | 96 (1.01) | 234 (1.13) | 7 (0.10) | 99 (1.19) | 752 (0.87) |
| L70Q/A91G/I118A/ T120S/T130A/K169E | 123 (1.29) | 226 (1.09) | 7 (0.10) | 86 (1.03) | 741 (0.86) |
| V4M/L70Q/A91G/I118V/T120S/T130A/ K169E | 89 (0.94) | 263 (1.26) | 6 (0.09) | 139 (1.67) | 991 (1.14) |
| L70Q/A91G/I118V/T120S/ T130A/K169E | 106 (1.12) | 263 (1.26) | 6 (0.09) | 104 (1.25) | 741 (0.86) |
| V20L/L70Q/A91S/ I118V/T120S/T130A | 105 (1.11) | 200 (0.96) | 9 (0.13) | 195 (2.34) | 710 (0.82) |
| S44P/L70Q/A91G/T130A | 88 (0.92) | 134 (0.64) | 5 (0.07) | 142 (1.71) | 854 (0.99) |
| L70Q/A91G/E117G/ I118V/T120S/T130A | 120 (1.27) | 193 (0.93) | 6 (0.08) | 98 (1.05) | 736 (0.85) |
| A91G/I118V/T120S/T130A | 84 (0.89) | 231 (1.11) | 44 (0.62) | 276 (3.33) | 714 (0.82) |
| L70R/A91G/ I118V/T120S/T130A/T199S | 125 (1.32) | 227 (1.09) | 6 (0.09) | 105 (1.26) | 702 (0.81) |
| L70Q/E81A/A91G/ I118V/T120S/I127T/T130A | 140 (1.48) | 185 (0.89) | 18 (0.25) | 98 (1.18) | 772 (0.89) |
| L70Q/Y87N/A91G/T130A | 108 (1.13) | 181 (0.87) | 6 (0.08) | 136 (1.63) | 769 (0.89) |
| T28S/L70Q/A91G/I118V/E95K/T120S/ I126V/T130A/K169E | 32 (0.34) | 65 (0.31) | 6 (0.08) | 120 (1.44) | 834 (0.96) |
| N63S/L70Q/A91G/S114T/I118V/ T120S/T130A | 124 (1.30) | 165 (0.79) | 6 (0.08) | 116 (1.39) | 705 (0.81) |
| K36E/I67T/L70Q/A91G/ I118V/T120S/T130A/N152T | 8 (0.09) | 21 (0.10) | 5 (0.08) | 53 (0.63) | 852 (0.98) |
| E52G/L70Q/A91G/ D107N/I118V/T120S/T130A K169E | 113 (1.19) | 245 (1.18) | 6 (0.08) | 94 (1.13) | 874 (1.01) |
| K37E/F59S/L70Q/A91G/ I118V/T120S/T130A/K185E | 20 (0.21) | 74 (0.36) | 6 (0.08) | 109 (1.31) | 863 (1.00) |
| A91G/S103P | 39 (0.41) | 56 (0.27) | 9 (0.13) | 124 (1.49) | 670 (0.77) |
| K89E/T130A | 90 (0.95) | 148 (0.71) | 75 (1.07) | 204 (2.45) | 761 (0.88) |
| A91G | 96 (1.01) | 200 (0.96) | 85 (1.21) | 220 (2.65) | 877 (1.01) |
| D60V/A91G/I118V/T120S/ T130A/K169E | 111 (1.17) | 222 (1.07) | 12 (0.18) | 120 (1.44) | 744 (0.86) |
| K54M/L70Q/A91G/Y164H | 68 (0.71) | 131 (0.63) | 5 (0.08) | 152 (1.83) | 685 (0.79) |
| M38T/L70Q/E77G/A91G/ I118V/T120S/T130A/N152T | 61 (0.64) | 102 (0.49) | 5 (0.07) | 119 (1.43) | 796 (0.92) |
| R29H/E52G/L70R/E88G/A91G/T130A | 100 (1.05) | 119 (0.57) | 5 (0.08) | 200 (2.41) | 740 (0.85) |
| Y31H/T41G/M43L/L70Q/A91G/ I118V/T120S/I126V/T130A | 85 (0.89) | 85 (0.41) | 6 (0.08) | 288 (3.47) | 782 (0.90) |
| V68A/T110A | 103 (1.08) | 233 (1.12) | 48 (0.68) | 163 (1.96) | 861 (0.99) |
| L65H/D90G/T110A/F116L | 33 (0.35) | 121 (0.58) | 11 (0.15) | 129 (1.55) | 758 (0.88) |
| R29H/E52G/D90N/I118V/T120S/ T130A | 66 (0.69) | 141 (0.68) | 11 (0.15) | 124 (1.49) | 800 (0.92) |
| A91G/L102S | 6 (0.06) | 6 (0.03) | 5 (0.08) | 75 (0.90) | 698 (0.81) |
| I67T/L70Q/A91G/I118V T120S | 98 (1.03) | 160 (0.77) | 5 (0.08) | 1751 (21.1) | 794 (0.92) |
| L70Q/A91G/T110A/ I118V/T120S/T130A | 8 (0.09) | 14 (0.07) | 5 (0.07) | 77 (0.93) | 656 (0.76) |
| M38V/T41D/M43I/ W50G/D76G/V83A/K89E/ I118V/T120S/I126V/T130A | 5 (0.06) | 8 (0.04) | 8 (0.11) | 82 (0.99) | 671 (0.78) |
| V22A/L70Q/S121P | 5 (0.06) | 7 (0.04) | 5 (0.07) | 105 (1.27) | 976 (1.13) |
| A12V/S15F/Y31H/M38L/ T41G/M43L/D90N/T130A/P137L/ N149D N152T | 6 (0.06) | 6 (0.03) | 5 (0.08) | 104 (1.25) | 711 (0.82) |
| I67F/L70R/E88G/ A91G/I118V/T120S/T130A | 5 (0.05) | 6 (0.03) | 6 (0.08) | 62 (0.74) | 1003 (1.16) |
| E24G/L25P/L70Q/A91G/I118V/T120S/ N152T | 26 (0.27) | 38 (0.18) | 8 (0.11) | 101 (1.21) | 969 (1.12) |
| A91G/F92L/F108L/I118V/T120S | 50 (0.53) | 128 (0.61) | 16 (0.11) | 59 (0.71) | 665 (0.77) |
| WT CD80 | 95 (1.00) | 208 (1.00) | 70 (1.00) | 83 (1.00) | 866 (1.00) |

Molecule sequences, binding data, and costimulatory bioactivity data.

TABLE E11B

CD80 variants selected against PD-L1.

| CD80 mutation(s) | Binding CD28 MFI (parental ratio) | CTLA-4 MFI (parental ratio) | PD-L1 MFI (parental ratio) | Coimmobilization with anti-CD3 IFN-gamma pg/mL (parental ratio) | MLR IFN-gamma levels pg/mL (parental ratio) |
|---|---|---|---|---|---|
| R29D/Y31L/Q33H/K36G/M38I/T41A/M43R/M47T/E81V/L85R/K89N/A91T/F92P/K93V/R94L/I118T/N149S | 1071 (0.08) | 1089 (0.02) | 37245 (2.09) | 387 (0.76) | 5028 (0.26) |
| R29D/Y31L/Q33H/K36G/M38I/T41A/M43R/M47T/E81V/L85R/K89N/A91T/F92P/K93V/R94L/N144S/N149S | 1065 (0.08) | 956 (0.02) | 30713 (1.72) | 400 (0.79) | 7943 (0.41) |
| R29D/Y31L/Q33H/K36G/M38I/T41A/M42T/M43R/M47T/E81V/L85R/K89N/A91T/F92P/K93V/R94L/L148S/N149S | 926 (0.07) | 954 (0.02) | 47072 (2.64) | 464 (0.91) | 17387 (0.91) |
| E24G/R29D/Y31L/Q33H/K36G/M38I/T41A/M43R/M47T/F59L/E81V/L85R/K89N/A91T/F92P/K93V/R94L/H96R | 1074 (0.08) | 1022 (0.02) | 1121 (0.06) | 406 (0.80) | 13146 (0.69) |
| R29D/Y31L/Q33H/K36G/M38I/T41A/M43R/M47T/E81V/L85R/K89N/A91T/F92P/K93V/R94L/N149S | 1018 (0.08) | 974 (0.02) | 25434 (1.43) | 405 (0.80) | 24029 (1.25) |
| R29V/M43Q/E81R/L85I/K89R/D90L/A91E/F92N/K93Q/R94G | 1029 (0.08) | 996 (0.02) | 1575 (0.09) | 342 (0.67) | 11695 (0.61) |
| T41I/A91G | 17890 (1.35) | 50624 (1.01) | 12562 (0.70) | 433 (0.85) | 26052 (1.36) |
| E88D/K89R/D90K/A91G/F92Y/K93R/N122S/N178S | 41687 (3.15) | 49429 (0.99) | 20140 (1.13) | 773 (1.52) | 6345 (0.33) |
| E88D/K89R/D90K/A91G/F92Y/K93R | 51663 (3.91) | 72214 (1.44) | 26405 (1.48) | 1125 (2.21) | 9356 (0.49) |
| K36G/K37Q/M38I/L40M/F59L/E81V/L85R/K89N/A91T/F92P/K93V/R94L/E99G/T130A/N149S | 1298 (0.10) | 1271 (0.03) | 3126 (0.18) | 507 (1.00) | 3095 (0.16) |
| E88D/K89R/D90K/A91G/F92Y/K93R | 31535 (2.38) | 50868 (1.02) | 29077 (1.63) | 944 (1.85) | 5922 (0.31) |
| K36G/K37Q/M38I/L40M | 1170 (0.09) | 1405 (0.03) | 959 (0.05) | 427 (0.84) | 811 (0.04) |
| K36G/L40M | 29766 (2.25) | 58889 (1.18) | 20143 (1.13) | 699 (1.37) | 30558 (1.59) |
| WTCD80 | 13224 (1.00) | 50101 (1.00) | 17846 (1.00) | 509 (1.00) | 19211 (1.00) |

Molecule sequences, binding data, and costimulatory bioactivity data.

TABLE E11C

CD80 variants selected against CTLA-4 or PD-L1.

| CD80 mutation(s) | CD28 tfxn MFI (parental ratio) | CTLA-4 tfxn MFI (parental ratio) | PD-L1 tfxn MFI (parental ratio) | Anti-CD3 IFN-gamma Coimmobilization Assay pg/mL (parental ratio) |
|---|---|---|---|---|
| R29D, Y31L, Q33H, K36G, M38I, T41A, M43R, M47T, E81V, L85R, K89N, A91T, F92P, K93V, R94L, I118V, T120S, I127T, T130A, K169E | 3536 (0.08) | 5731 (0.01) | 173405 (0.08) | 109 (0.24) |
| R29D, Y31L, Q33H, K36G, M38I, T41A, M43R, M47T, L70Q, E81V, L85R, K89N, A91T, F92P, K93V, R94L, I118V, T120S, I127T, T130A, | 4962 (0.11) | 2027 (0.01) | 626341 (0.11) | 162 (0.36) |
| H18L, R29D, Y31L, Q33H, K36G, M38I, T41A, M43R, M47T, E81V, L85R, K89N, A91T, F92P, K93V, R94L, I118V, T120S, I127T, T130A, K169E | 3489 (0.08) | 2521 (0.01) | 215826 (0.08) | 206 (0.46) |
| R29D, Y31L, Q33H, K36G, M38I, T41A, M43R, M47T, E81V, L85R, K89N, A91T, F92P, K93V, R94L, I118V, T120S, T130A, K169E, M174T | 2736 (0.06) | 2493 (0.01) | 157897 (0.06) | 141 (0.31) |
| R29D, Y31L, Q33H, K36G, M38I, T41A, M43R, M47T, N48D, F59L, E81V, L85R, K89N, A91T, F92P, K93V, R94L, I118V, T120S, I127T, T130A, H188D | 2393 (0.05) | 2663 (0.01) | 137062 (0.05) | 230 (0.51) |
| H18R, R29D, Y31L, Q33H, K36G, K37E, M38I, T41A, M43R, M47T, L70Q, E81V, L85R, K89N, A91T, F92P, K93V, R94L, I118V, T120S, T130A, K169E, H188D | 3023 (0.07) | 2303 (0.01) | 158977 (0.07) | 305 (0.68) |
| R29D, Y31L, Q33H, K36G, M38I, T41A, M43R, M47T, L70Q, E81V, L85R, K89N, A91T, F92P, K93V, R94L, I118V, T120S, I127T, T130A, E143G, K169E, M174V, H188D | 2135 (0.05) | 2816 (0.01) | 374117 (0.05) | 291 (0.65) |
| R29D, Y31L, Q33H, K36G, M38I, T41A, M43R, M47T, E81V, L85R, K89N, A91T, F92P, K93V, R94L, I118V, T120S, I127T, T130A, K169E | 2157 (0.05) | 2819 (0.01) | 114963 (0.05) | 197 (0.44) |
| R29D, Y31L, Q33H, K36G, M38I, T41A, M43R, M47T, L70Q, E81V, L85R, K89N, A91T, F92P, K93V, R94L, I118V, T120S, I127T, T130A | 2126 (0.05) | 2377 (0.01) | 530029 (0.05) | 135 (0.30) |

TABLE E11C-continued

CD80 variants selected against CTLA-4 or PD-L1.

| CD80 mutation(s) | CD28 tfxn MFI (parental ratio) | CTLA-4 tfxn MFI (parental ratio) | PD-L1 tfxn MFI (parental ratio) | Anti-CD3 IFN-gamma Coimmobilization Assay pg/mL (parental ratio) |
|---|---|---|---|---|
| R29D, I30V, Y31L, Q33H, K36G, M38I, T41A, M43R, M47T, E81V, L85R, K89N, A91T, F92P, K93V, R94L, I118V, T120S, I127T, T130A, H188D | 1914 (0.04) | 2024 (0.01) | 179536 (0.04) | 127 (0.28) |
| R29D, Y31L, Q33H, K36G, M38I, T41A, M43R, M47T, L70Q, E81V, L85R, K89N, A91T, F92P, K93V, R94L, I118V, T120S, I127T, T130A, K169E | 2377 (0.05) | 2177 (0.01) | 438352 (0.05) | 203 (0.45) |
| R29D, Y31L, Q33H, K36G, M38I, T41A, M43R, M47T, L70Q, E81V, K89N, A91T, F92P, K93V, R94L, I118V, T120S, I127T, T130A | 2106 (0.05) | 2122 (0.01) | 14201 (0.05) | 226 (0.50) |
| R29D, Y31L, Q33H, K36G, M38I, T41A, M43R, M47T, L85R, K89N, A91T, F92P, K93V, R94L, I118V, T120S, I127T, T130A, K169E, H188D | 1887 (0.04) | 2201 (0.01) | 110092 (0.04) | 231 (0.51) |
| R29D, I30V, Y31L, Q33H, K36G, M38I, T41A, M43R, M47T, E81V, L85R, K89N, A91T, F92P, K93V, R94L, I118V, T120S, I127T, T130A, H188D | 2060 (0.05) | 2385 (0.01) | 94786 (0.05) | 237 (0.53) |
| R29D, Y31L, Q33H, K36G, M38I, T41A, M43R, M47T, E81V, L85R, K89N, A91T, F92P, K93V, R94L, F108L, I118V, T120S, T130A, K169E, H188D | 2009 (0.04) | 2623 (0.01) | 110589 (0.04) | 165 (0.37) |
| R29D, Y31L, Q33H, K36G, M38I, T41A, M43R, M47T, L70Q, E81V, L85R, K89N, A91T, F92P, K93V, R94L, T130A, H188D | 1925 (0.04) | 2979 (0.01) | 379558 (0.04) | 213 (0.47) |
| R29D, Y31L, Q33H, K36G, M38I, T41A, M43R, M47T, L70Q, E81V, L85R, K89N, A91T, F92P, K93V, R94L, I118V, T120S, T130A, N149D, K169E, H188D | 2245 (0.05) | 2842 (0.01) | 631549 (0.05) | 118 (0.26) |
| H18L, R29D, Y31L, Q33H, K36G, M38I, T41A, M43R, M47T, L70Q, E81V, L85R, K89N, A91T, F92P, K93V, R94L, I118V, T120S, T130A, K169E, H188D | 2759 (0.06) | 2247 (0.01) | 760438 (0.06) | 157 (0.35) |

TABLE E11C-continued

CD80 variants selected against CTLA-4 or PD-L1.

| CD80 mutation(s) | CD28 tfxn MFI (par

TABLE E11C-continued

CD80 variants selected against CTLA-4 or PD-L1.

| CD80 mutation(s) | CD28 tfxn MFI (parental ratio) | CTLA-4 tfxn MFI (parental ratio) | PD-L1 tfxn MFI (parental ratio) | Anti-CD3 IFN-gamma Coimmobilization Assay pg/mL (parental ratio) |
|---|---|---|---|---|
| R29D, Y31L, Q33H, K36G, M38I, T41A, M43R, M47T, E81V, L85R, K89N, A91T, F92P, K93V, R94L, I118T, T130A, S140T, N149S, K169S | 2460 (0.15) | 2188 (0.03) | 109263 (10.36) | 150 (0.81) |
| R29D, Y31L, Q33H, K36G, M38I, T41A, M43R, M47T, E81V, L85R, K89N, A91T, F92P, K93V, R94L, I118T, T130A, N149S, K169I, Q193L | 2569 (0.16) | 2198 (0.03) | 100074 (9.49) | 130 (0.70) |
| R29D, Y31L, Q33H, K36G, M38I, T41A, M43R, M47T, E81V, L85R, K89N, A91T, F92P, K93V, R94L, V22A, I118T, T130A, N149S | 2500 (0.16) | 2188 (0.03) | 147900 (14.03) | 124 (0.67) |
| R29D, Y31L, Q33H, K36G, M38I, T41A, M43R, M47T, E81V, L85R, K89N, A91T, F92P, K93V, R94L, I118T, T130A, N149S | 2615 (0.16) | 2210 (0.03) | 118150 (11.21) | 89 (0.48) |
| R29D, Y31L, Q33H, K36G, M38I, T41A, M43R, M47T, E81V, L85R, K89N, A91T, F92P, K93V, R94L, I118T, T130A, N149S, K169I | 2444 (0.15) | 2246 (0.03) | 115420 (10.95) | 101 (0.55) |
| R29D, Y31L, Q33H, K36G, M38I, T41A, M43R, M47T, E81V, L85R, K89N, A91T, F92P, K93V, R94F, T130A, N149S, K169I | 2378 (0.15) | 2123 (0.03) | 112712 (10.69) | 114 (0.61) |
| I118T, C128R | 3093 (0.19) | 3180 (0.03) | 2620 (0.25) | 122 (0.66) |
| Q27R, R29C, M42T, S129P, E160G | 2827 (0.18) | 2623 (0.03) | 2326 (0.22) | 139 (0.75) |
| S129P, T154A | 3062 (0.19) | 2622 (0.03) | 2606 (0.25) | 156 (0.84) |
| WT CD80 | 15948 (1.00) | 75099 (1.00) | 10544 (1.00) | 185 (1.00) |

Molecule sequences, binding data, and costimulatory bioactivity data.

Example 11

Generation and Assessment of Binding of Stacked Molecules Containing Variant PD-1 Molecules and CD28-Binding IgSF Domain This Example describes immunomodulatory proteins that were generated as multi-domain stack constructs containing PD-1 polypeptides and ICOSL polypeptides. Specifically, a wild-type PD-1 (6-127) (SEQ ID NO: 392) or exemplary variant PD-1 (6-127) IgV domain with V44H/L45V/N46I/Y48H/M50E/N54G/K58T/L102V/A105V/A112I (SEQ ID NO:453) and exemplary variant ICOSL IgV molecules with mutations N52H/Q100R (SEQ ID NO: 807), N52H/N57Y/Q100R (SEQ ID NO: 808), N52L/N57H/Q100R (SEQ ID NO: 809) or N52S/N194D (SEQ ID NO: 810) were linked together and fused to an Fc in various configurations to generate homodimeric multi-domain stack Fc fusion proteins.

For generating homodimeric Fc fusions, an exemplary IgG1 Fc region set forth in SEQ ID NO: 384 or 476 was used, which contained the mutations L234A, L235E, G237A by EU numbering (corresponding to L19A, L20E, G22A, with reference to wild-type human IgG1 Fc set forth in SEQ ID NO:390). Further, the Fc region contained replacement of the cysteine residues to a serine residue at position 5 (C5S) compared to the wild-type or unmodified Fc set forth in SEQ ID NO: 390 (corresponding to C220S by EU numbering). The Fc region set forth in SEQ ID NO:476 also lacked the C-terminal lysine at position 447 (designated K447del) by EU numbering (corresponding to position 232 of the wild-type or unmodified Fc). Homodimeric stacks were generated in various configurations in which the wild-type or variant PD-1 IgV and/or variant ICOSL IgV were variously linked to the N- or C-terminus of the human IgG1 Fc region via a GSGGGGS (SEQ ID NO: 471) or 3×GGGGS (SEQ ID NO: 473) peptide linker. Exemplary generated stacks are set forth below.

ICOSL/PD-1 Stack 1 (SEQ ID NO: 477): ICOSL variant N52H/Q100R (SEQ ID NO: 807)-3×G₄S linker (SEQ ID NO: 473) PD-1 variant (SEQ ID NO:453)-GSGGGGS linker (SEQ ID NO:471)-Fc (SEQ ID NO:384)

ICOSL/PD-1 Stack 2 (SEQ ID NO: 478): PD-1 variant (SEQ ID NO: 453)-3×G₄S linker (SEQ ID NO: 473)-ICOSL variant N52H/Q100R (SEQ ID NO: 807)-GSGGGGS linker (SEQ ID NO:471)-Fc (SEQ ID NO:384)

ICOSL/PD-1 Stack 3 (SEQ ID NO: 479): ICOSL variant N52H/N57Y/Q100R (SEQ ID NO: 808)-3×G₄S linker (SEQ ID NO: 473)-PD-1 variant (SEQ ID NO:453)-GSGGGGS linker (SEQ ID NO:471)-Fc (SEQ ID NO:384)

ICOSL/PD-1 Stack 4 (SEQ ID NO: 480): PD-1 variant (SEQ ID NO: 453)-3×G₄S linker (SEQ ID NO: 473)-ICOSL variant N52H/N57Y/Q100R (SEQ ID NO: 808)-GSGGGGS linker (SEQ ID NO:471)-Fc (SEQ ID NO:384)

ICOSL/PD-1 Stack 5 (SEQ ID NO: 481): ICOSL variant N52S/N194D (SEQ ID NO: 810)-3×G₄S linker (SEQ ID NO: 473)-PD-1 variant (SEQ ID NO: 453)-GSGGGGS linker (SEQ ID NO:471)-Fc (SEQ ID NO:384)

ICOSL/PD-1 Stack 6 (SEQ ID NO: 482): PD-1 variant (SEQ ID NO:453)-3×G₄S linker (SEQ ID NO: 473)-ICOSL variant N52S/N194D (SEQ ID NO: 810)-GSGGGGS linker (SEQ ID NO:471)-Fc (SEQ ID NO:384)

ICOSL/PD-1 Stack 7 (SEQ ID NO: 483): ICOSL variant N52H/Q100R (SEQ ID NO: 807)-3×G₄S linker (SEQ ID NO: 473)-wild-type PD-1 (SEQ ID NO: 392)-GSGGGGS linker (SEQ ID NO:471)-Fc (SEQ ID NO:384)

ICOSL/PD-1 Stack 8 (SEQ ID NO: 484): wild-type PD-1 (SEQ ID NO: 392)-3×G₄S linker (SEQ ID NO: 473)-

ICOSL variant N52H/Q100R (SEQ ID NO: 807)-GSGGGGS linker (SEQ ID NO:471)-Fc (SEQ ID NO:384)

ICOSL/PD-1 Stack 9 (SEQ ID NO: 485): ICOSL variant N52H/N57Y/Q100R (SEQ ID NO: 808)-3×G$_4$S linker (SEQ ID NO: 473)-wild-type PD-1 (SEQ ID NO:392)-GSGGGGS linker (SEQ ID NO:471)-Fc (SEQ ID NO:384)

ICOSL/PD-1 Stack 10 (SEQ ID NO: 486): ICOSL variant N52S/N194D (SEQ ID NO: 810)-3×G$_4$S linker (SEQ ID NO: 473)-wild-type PD-1 (SEQ ID NO: 392)-GSGGGGS linker (SEQ ID NO:471)-Fc (SEQ ID NO:384)

ICOSL/PD-1 Stack 11 (SEQ ID NO: 487): wild-type PD-1 (SEQ ID NO: 392)-3×G$_4$S linker (SEQ ID NO: 473)-ICOSL variant N52S/N194D (SEQ ID NO: 810)-GSGGGGS linker (SEQ ID NO:471)-Fc (SEQ ID NO:384)

ICOSL/PD-1 Stack 12 (SEQ ID NO: 781): ICOSL variant N52H/Q100R (SEQ ID NO: 807)-3×G$_4$S linker (SEQ ID NO: 473)-PD-1 variant (SEQ ID NO:430)-GSGGGGS linker (SEQ ID NO:471)-Fc (SEQ ID NO: 476)

ICOSL/PD-1 Stack 13 (SEQ ID NO: 782): ICOSL variant N52H/Q100R (SEQ ID NO: 807)-3×G$_4$S linker (SEQ ID NO: 473)-PD-1 variant (SEQ ID NO:445)-GSGGGGS linker (SEQ ID NO:471)-Fc (SEQ ID NO: 476)

ICOSL/PD-1 Stack 14 (SEQ ID NO: 783): ICOSL variant N52H/Q100R (SEQ ID NO: 807)-3×G$_4$S linker (SEQ ID NO: 473)-PD-1 variant (SEQ ID NO:446)-GSGGGGS linker (SEQ ID NO:471)-Fc (SEQ ID NO: 476)

ICOSL/PD-1 Stack 15 (SEQ ID NO: 784): ICOSL variant N52L/N57H/Q100R (SEQ ID NO: 809)-3×G$_4$S linker (SEQ ID NO: 473)-PD-1 variant (SEQ ID NO:430)-GSGGGGS linker (SEQ ID NO:471)-Fc (SEQ ID NO: 476)

ICOSL/PD-1 Stack 16 (SEQ ID NO: 785): ICOSL variant N52L/N57H/Q100R (SEQ ID NO: 809)-3×G$_4$S linker (SEQ ID NO: 473)-PD-1 variant (SEQ ID NO:445)-GSGGGGS linker (SEQ ID NO:471)-Fc (SEQ ID NO: 476)

ICOSL/PD-1 Stack 17 (SEQ ID NO: 786): ICOSL variant N52L/N57H/Q100R (SEQ ID NO: 809)-3×G$_4$S linker (SEQ ID NO: 473)-PD-1 variant (SEQ ID NO:446)-GSGGGGS linker (SEQ ID NO:471)-Fc (SEQ ID NO: 476)

ICOSL/PD-1 Stack 18 (SEQ ID NO: 787): ICOSL variant N52H/Q100R (SEQ ID NO: 807)-GSGGGGS linker (SEQ ID NO:471)-Fc (SEQ ID NO: 476)-3×G$_4$S linker (SEQ ID NO: 473)-PD-1 variant (SEQ ID NO:430)

ICOSL/PD-1 Stack 19 (SEQ ID NO: 788): ICOSL variant N52H/Q100R (SEQ ID NO: 807)-GSGGGGS linker (SEQ ID NO:471)-Fc (SEQ ID NO: 476)-3×G$_4$S linker (SEQ ID NO: 473)-PD-1 variant (SEQ ID NO:445)

ICOSL/PD-1 Stack 20 (SEQ ID NO: 789): ICOSL variant N52H/Q100R (SEQ ID NO: 807)-GSGGGGS linker (SEQ ID NO:471)-Fc (SEQ ID NO: 476)-3×G$_4$S linker (SEQ ID NO: 473)-PD-1 variant (SEQ ID NO:446)

ICOSL/PD-1 Stack 21 (SEQ ID NO: 790): ICOSL variant N52L/N57H/Q100R (SEQ ID NO: 809)-GSGGGGS linker (SEQ ID NO:471)-Fc (SEQ ID NO: 476)-3×G$_4$S linker (SEQ ID NO: 473)-PD-1 variant (SEQ ID NO:430)

ICOSL/PD-1 Stack 22 (SEQ ID NO: 791): ICOSL variant N52L/N57H/Q100R (SEQ ID NO: 809)-GSGGGGS linker (SEQ ID NO:471)-Fc (SEQ ID NO: 476)-3×G$_4$S linker (SEQ ID NO: 473)-PD-1 variant (SEQ ID NO:445)

ICOSL/PD-1 Stack 23 (SEQ ID NO: 792): ICOSL variant N52L/N57H/Q100R (SEQ ID NO: 809)-GSGGGGS linker (SEQ ID NO:471)-Fc (SEQ ID NO: 476)-3×G$_4$S linker (SEQ ID NO: 473)-PD-1 variant (SEQ ID NO:446)

ICOSL/PD-1 Stack 24 (SEQ ID NO: 793): PD-1 variant (SEQ ID NO:430)-3×G$_4$S linker (SEQ ID NO: 473)-ICOSL variant N52H/Q100R (SEQ ID NO: 807)-GSGGGGS linker (SEQ ID NO:471)-Fc (SEQ ID NO: 476)

ICOSL/PD-1 Stack 25 (SEQ ID NO: 794): PD-1 variant (SEQ ID NO:445)-3×G$_4$S linker (SEQ ID NO: 473)-ICOSL variant N52H/Q100R (SEQ ID NO: 807)-GSGGGGS linker (SEQ ID NO:471)-Fc (SEQ ID NO: 476)

ICOSL/PD-1 Stack 26 (SEQ ID NO: 795): PD-1 variant (SEQ ID NO:446)-3×G$_4$S linker (SEQ ID NO: 473)-ICOSL variant N52H/Q100R (SEQ ID NO: 807)-GSGGGGS linker (SEQ ID NO:471)-Fc (SEQ ID NO: 476)

ICOSL/PD-1 Stack 27 (SEQ ID NO: 796): PD-1 variant (SEQ ID NO:430)-3×G$_4$S linker (SEQ ID NO: 473)-ICOSL variant N52L/N57H/Q100R(SEQ ID NO: 809)-GSGGGGS linker (SEQ ID NO:471)-Fc (SEQ ID NO: 476)

ICOSL/PD-1 Stack 28 (SEQ ID NO: 797): PD-1 variant (SEQ ID NO:445)-3×G$_4$S linker (SEQ ID NO: 473)-ICOSL variant N52L/N57H/Q100R (SEQ ID NO: 809)-GSGGGGS linker (SEQ ID NO:471)-Fc (SEQ ID NO: 476)

ICOSL/PD-1 Stack 29 (SEQ ID NO: 798): PD-1 variant (SEQ ID NO:446)-3×G$_4$S linker (SEQ ID NO: 473)-ICOSL variant N52L/N57H/Q100R(SEQ ID NO: 809)-GSGGGGS linker (SEQ ID NO:471)-Fc (SEQ ID NO: 476)

ICOSL/PD-1 Stack 30 (SEQ ID NO: 799): PD-1 variant (SEQ ID NO:430)-GSGGGGS linker (SEQ ID NO:471)-Fc (SEQ ID NO: 476)-3×G$_4$S linker (SEQ ID NO: 473)-ICOSL variant N52H/Q100R (SEQ ID NO: 807)

ICOSL/PD-1 Stack 31 (SEQ ID NO: 800): PD-1 variant (SEQ ID NO:445)-GSGGGGS linker (SEQ ID NO:471)-Fc (SEQ ID NO: 476)-3×G$_4$S linker (SEQ ID NO: 473)-ICOSL variant N52H/Q100R (SEQ ID NO: 807)

ICOSL/PD-1 Stack 32 (SEQ ID NO: 801): PD-1 variant (SEQ ID NO:446)-GSGGGGS linker (SEQ ID NO:471)-Fc (SEQ ID NO: 476)-3×G$_4$S linker (SEQ ID NO: 473)-ICOSL variant N52H/Q100R (SEQ ID NO: 807)

ICOSL/PD-1 Stack 33 (SEQ ID NO: 802): PD-1 variant (SEQ ID NO:430)-GSGGGGS linker (SEQ ID NO:471)-Fc (SEQ ID NO: 476)-3×G$_4$S linker (SEQ ID NO: 473)-ICOSL variant N52L/N57H/Q100R (SEQ ID NO: 809)

ICOSL/PD-1 Stack 34 (SEQ ID NO: 803): PD-1 variant (SEQ ID NO:445)-GSGGGGS linker (SEQ ID NO:471)-Fc (SEQ ID NO: 476)-3×G$_4$S linker (SEQ ID NO: 473)-ICOSL variant N52L/N57H/Q100R (SEQ ID NO: 809)

ICOSL/PD-1 Stack 35 (SEQ ID NO: 804): PD-1 variant (SEQ ID NO:446)-GSGGGGS linker (SEQ ID NO:471)-Fc (SEQ ID NO: 476)-3×G₄S linker (SEQ ID NO: 473)-ICOSL variant N52L/N57H/Q100R (SEQ ID NO: 809)

The exemplary stacks were generated by expression of DNA constructs that also included a signal sequence encoding the sequence set forth in SEQ ID NO: 389 (MGSTAILALLLAVLQGVSA). The multi-domain Fc fusion stack constructs were purified substantially as described in Example 5.

Binding studies were carried out to assess specificity and affinity of exemplary PD-1/ICOSL stack immunomodulatory proteins generated as described above for binding to cognate binding partners. As a control, single IgSF-Fc fusion molecules wild-type PD-1 (6-127)-Fc (SEQ ID NO:488), variant PD-1 (6-127) with V44H/L45V/N46I/Y48H/M50E/N54G/K58T/L102V/A105V/A112I (SEQ ID NO:489), variant ICOSL with N52H/Q100R (SEQ ID NO: 807), ICOSL with N52H/N57Y/Q100R (SEQ ID NO: 808), or ICOSL with N52S/N194D (SEQ ID NO: 810), each also fused to the Fc set forth in SEQ ID NO: 384 via a GSGGGGS (SEQ ID NO: 471) or AAA peptide linker, also were assessed. In addition, an anti-PD-L1 antibody, a non-specific human IgG1 antibody and an inert Fc only (SEQ ID NO: 476) control were also assessed.

Binding studies were carried out using Jurkat cells that endogenously express CD28 or Chinese Hamster Ovary (CHO) cells that were transduced to stably express human PD-L1, human CTLA-4, or human ICOS. For staining by flow cytometry, 100,000 cells were plated in 96-well round-bottom plates. Cells were spun down and resuspended in staining buffer (PBS (phosphate buffered saline), 1% BSA (bovine serum albumin), and 0.1% sodium azide) for 20 minutes to block non-specific binding. Afterwards, cells were centrifuged again and resuspended in 50 μL staining buffer containing 0.05 nM to 50 nM of each control or candidate multi-domain stack Fc fusion protein. Primary staining was performed on ice for 45 minutes, before washing cells twice in 150 μL staining buffer. PE-conjugated anti-human Fc (Jackson ImmunoResearch, USA) was diluted 1:200 in 50 μL staining buffer and added to cells and incubated another 30 minutes on ice. Secondary antibody was washed out twice, cells were fixed in 4% formaldehyde/PBS, and samples were analyzed on LSRII flow cytometer (BD Biosciences, USA).

Mean Fluorescence Intensity (MFI) was calculated with FlowJo Version 10 software (FlowJo LLC, USA). Table E12 sets forth representative binding activity as measured by the Mean Fluorescence Intensity (MFI) value for binding of 12.5 nM of each stack Fc-fusion molecule or controls. As shown in Table E12, several stack proteins bound one or more of PD-L1, CD28, CTLA-4, and ICOS, and in some cases all binding partners, with high affinity. Multi-domain stack immunomodulatory proteins worked when the variant PD-1 molecule was configured on either the N- or C-terminus.

TABLE E12

Stacked molecules containing PD-1/ICOSL variants and binding data

| Description | SEQ ID NO | Flow Binding to Transfected Cell Lines MFI at 12.5 nM concentration | | | |
|---|---|---|---|---|---|
| | | PD-L1 | CD28 | CTLA4 | ICOS |
| ICOSL variant IgV (N52H/Q100R; SEQ ID NO: 807) - AAA - Fc | — | 45.7 | 4281 | 14618 | 16192 |
| ICOSL variant IgV (N52H/N57Y/Q100R; SEQ ID NO: 808) - AAA - Fc | — | 48.2 | 4237 | 27476 | 21975 |
| ICOSL variant IgV (N52S/N194D; SEQ ID NO: 810) - AAA - Fc | — | 46.2 | 474 | 302 | 18200 |
| PD-1 variant Fc: PD-1(6-127) variant - GSG4S - Fc | 489 | 32731 | 112 | 79.6 | 83.5 |
| ICOSL/PD-1 Stack 1: ICOSL variant IgV - 3xG4S - PD-1(6-127) variant - GSG4S - Fc | 477 | 30268 | 2911 | 3975 | 13114 |
| ICOSL/PD-1 Stack 2: PD-1(6-127) variant - 3xG4S - ICOSL variant IgV - GSG4S - Fc | 478 | 34728 | 3034 | 282 | 10675 |
| ICOSL/PD-1 Stack 3: ICOSL variant IgV - 3xG4S - PD-1(6-127) variant - GSG4S - Fc | 479 | 21393 | 3663 | 19165 | 12353 |
| ICOSL/PD-1 Stack 4: PD-1(6-127) variant - 3xG4S - ICOSL variant IgV - GSG4S - Fc | 480 | 34193 | 3754 | 15419 | 11171 |
| ICOSL/PD-1 Stack 5: ICOSL variant IgV - 3xG4S - PD-1(6-127) variant - GSG4S - Fc | 481 | 25727 | 162 | 89.9 | 14416 |
| ICOSL/PD-1 Stack 6: PD-1(6-127) variant - 3xG4S - ICOSL variant IgV - GSG4S - Fc | 482 | 29305 | 157 | 65.5 | 9034 |
| ICOSL/PD-1 Stack 7: ICOSL variant IgV - 3xG4S - Wild-type PD-1(6-127) - GSG4S - Fc | 483 | 1335 | 3554 | 13053 | 20520 |
| ICOSL/PD-1 Stack 8: Wild-type PD-1(6-127) - 3xG4S - ICOSL variant IgV - GSG4S - Fc | 484 | 4682 | 3176 | 187 | 9996 |
| ICOSL/PD-1 Stack 9: ICOSL variant IgV - 3xG4S - Wild-type PD-1(6-127) - GSG4S - Fc | 485 | 1917 | 4254 | 25038 | 15100 |

TABLE E12-continued

Stacked molecules containing PD-1/ICOSL variants and binding data

| Description | SEQ ID NO | Flow Binding to Transfected Cell Lines MFI at 12.5 nM concentration | | | |
|---|---|---|---|---|---|
| | | PD-L1 | CD28 | CTLA4 | ICOS |
| ICOSL/PD-1 Stack 10: ICOSL variant IgV - 3xG4S - Wild-type PD-1(6-127) - GSG4S - Fc | 486 | 866 | 173 | 149 | 14550 |
| ICOSL/PD-1 Stack 11: Wild-type PD-1(6-127) - 3xG4S - ICOSL variant IgV - GSG4S - Fc | 487 | 4591 | 50.1 | 59.1 | 7562 |
| Wild-type PD-1 Fc Wild-type PD-1(6-127) - GSG4S - Fc | 488 | 1872 | 14.1 | 56.5 | 65.5 |
| Anti-PD-L1 antibody (atezolizumab) | — | 33242 | 139 | 68.1 | 71.9 |
| Anti-PD-L1 antibody (avelumab) | — | 32851 | 122 | 55.2 | 53.9 |
| Anti-PD-L1 (durvalumab) | — | 33612 | 135 | 56.5 | 51.4 |
| hIgG1 | — | | 11.6 | 60.4 | 53.9 |
| Fc Control | 476 | 50.2 | 11.6 | 62.9 | 56.5 |

Example 12

Assessment of Bioactivity of Affinity-Matured PD-1—Containing Multi-Domain Stack Molecules in the Presence and Absence of PD-L1 Using a Jurkat/IL2 Reporter Assay This Example describes a Jurkat/IL2 reporter assay to assess the capacity of variant PD-1/ICOSL stack-Fc fusion molecules described in Example 11 to modulate CD28 costimulation signal in the presence or absence of PD-L1-expressing antigen presenting cells, CHO-derived artificial antigen presenting cells (aAPC) displaying transduced cell surface anti-CD3 single chain Fv (OKT3) (i.e., no PD-L1; CHO-OKT3), or OKT3 and PD-L1 (i.e., +PD-L1; CHO-OKT3-PDL1), were brought to $0.8 \times 10^6$ cells/mL, and 25 µL of cells were added to each well of an opaque, white 96-well microplate. To each well, 25 µL of test protein at concentrations ranging from 50 pM to 50000 pM were added to the CHO-OKT3 and CHO-OKT3-PDL1 cells. Test proteins included multi-domain stack immunomodulatory proteins ICOSL/PD-1 Stacks 1-11 set forth in Table E12. Control proteins also were similarly incubated, including single IgSF-Fc fusion molecules wild-type PD-1(6-127)-Fc (SEQ ID NO:488), variant PD-1(6-127) with V44H/L45V/N46I/Y48H/M50E/N54G/K58T/L102V/A105V/A112I-Fc (SEQ ID NO:489), three variant ICOSL-Fc molecules N52H/Q100R (SEQ ID NO: 807), N52H/N57Y/Q100R (SEQ ID NO: 808), or N52S/N194D (SEQ ID NO: 810), anti-PD-L1 antibody (avelumab), anti-PD-L1 antibody (durvalumab), hIgG1 or Fc only control. All test and control proteins were incubated with CHO-OKT3 and CHO-OKT3-PDL1 cells for 15 minutes at room temperature.

Jurkat effector cells expressing an IL-2-luciferase reporter (purchased from Promega Corp., USA) were suspended at $2 \times 10^6$ cells/mL in Jurkat Assay buffer (RPMI1640+5% FBS). Jurkat cells were then plated at 50 µL/well bringing the final volume of each well to 100 µL. Jurkat cells and CHO cells were incubated for 5 hours at 37 degrees Celsius in a humidified 5% $CO_2$ incubation chamber. Plates were then removed from the incubator and acclimated to room temperature for 15 minutes. 100 µL of a cell lysis and luciferase substrate solution (BioGlo luciferase reagent, Promega) were added to each well and the plates were incubated on an orbital shaker for 10 minutes. Luminescence was measured with a 1 second per well integration time using a BioTek Cytation luminometer, and a relative luminescence value (RLU) was determined for each test sample.

The results are shown in Table 13A. In the absence of PD-L1 on the aAPC, little to no co-stimulatory signal was observed consistent with the observation that PD-1/ICOSL containing stack immunomodulatory proteins require PD-L1 binding to induce a costimulatory signal via CD28. In the presence of PD-L1, all PD-1/ICOSL containing stack immunomodulatory proteins exhibited concentration-dependent CD28 costimulation. The level of costimulation correlated with the CD28 and/or PD-L1 binding affinity of the variant molecules. This result is consistent with the activity of the variant PD-1-containing stack immunomodulatory proteins to exhibit PD-L1-dependent CD28-mediated costimulation.

In a variation of the previous experiment, Jurkat/IL2 reporter cells stably expressing PD-1 (Jurkat/IL2/PD-1) were combined with CHO/OKT3/PD-L1 cells and the ICOSL-PD1-Fc or control proteins. This assay was designed to test the ability of the ICOSL-PD1-Fc molecules to both block PD-1/PD-L1 interaction as well as provide CD28-mediated costimulation. This assay was set up as described previously except the Jurkat/IL2 cells were replaced with Jurkat/IL2/PD-1 cells.

The results shown in Table E13B demonstrate that some ICOSL-PD1-Fc molecules are able to overcome PD-1/PD-L1 suppression of TCR activation. The ICOSL-PD-1-Fc molecules with higher PD-L1 and CD28 binding affinities tended to be more costimulatory than the constructs with wild-type PD-1 domains. The PD-L1 binding control proteins were able to block PD-1 suppression but unable to provide CD28 costimulation resulting in lower overall signal.

TABLE E13A

Jurkat Costimulation Assay: Jurkat/IL2 + CHO/OKT3/PD-L1

| Description | SEQ ID NO | Jurkat/IL2 PD-L1 dependent CD28 costimulation assay (RLU at 12.5 nM) | |
|---|---|---|---|
| | | aAPC = CHO/OKT3 | aAPC = CHO/OKT3/PD-L1 |
| ICOSL variant IgV (N52H/Q100R; SEQ ID NO: 807) - AAA - Fc | — | 718 | 640 |
| ICOSL variant IgV (N52H/N57Y/Q100R; SEQ ID NOL 808) - AAA - Fc | — | 745 | 692 |
| ICOSL variant IgV (N52S/N194D; SEQ ID NO: 810) - AAA - Fc | — | 604 | 621 |
| PD-1 variant Fc: PD-1 (6-127) variant - GSG4S - Fc | 489 | 533 | 691 |
| ICOSL/PD-1 Stack 1: ICOSL variant IgV - 3xG4S - PD-1 (6-127) variant - GSG4S - Fc | 477 | 638 | 3133 |
| ICOSL/PD-1 Stack 2: PD-1 (6-127) variant - 3xG4S - ICOSL variant IgV - GSG4S - Fc | 478 | 523 | 2759 |
| ICOSL/PD-1 Stack 3: ICOSL variant IgV - 3xG4S - PD-1 (6-127) variant - GSG4S - Fc | 479 | 673 | 2494 |
| ICOSL/PD-1 Stack 4: PD-1 (6-127) variant - 3xG4S - ICOSL variant IgV - GSG4S - Fc | 480 | 540 | 2254 |
| ICOSL/PD-1 Stack 5: ICOSL variant IgV - 3xG4S - PD-1 (6-127) variant - GSG4S - Fc | 481 | 523 | 2022 |
| ICOSL/PD-1 Stack 6: PD-1 (6-127) variant - 3xG4S - ICOSL variant IgV - GSG4S - Fc | 482 | 550 | 842 |
| ICOSL/PD-1 Stack 7: ICOSL variant IgV - 3xG4S - Wild-type PD-1 (6-127) - GSG4S - Fc | 483 | 604 | 3944 |
| ICOSL/PD-1 Stack 8: Wild-type PD-1 (6-127) - 3xG4S - ICOSL variant IgV - GSG4S - Fc | 484 | 493 | 2847 |
| ICOSL/PD-1 Stack 9: ICOSL variant IgV - 3xG4S - Wild-type PD-1 (6-127)- GSG4S - Fc | 485 | 552 | 3231 |
| ICOSL/PD-1 Stack 10: ICOSL variant IgV - 3xG4S - Wild-type PD-1 (6-127)- GSG4S - Fc | 486 | 498 | 619 |
| ICOSL/PD-1 Stack 11: Wild-type PD-1 (6-127)- 3xG4S - ICOSL variant IgV - GSG4S - Fc | 487 | 509 | 563 |
| Wild-type PD-1 Fc Wild-type PD-1 (6-127)- GSG4S - Fc | 488 | 540 | 651 |
| Anti-PD-L1 antibody (atezolizumab) | — | 493 | 605 |
| hIgG1 | — | 375 | 531 |
| Fc Control | 476 | 463 | 542 |

TABLE E13B

Jurkat Costimulation Assay with PD1 blockade: Jurkat/IL2/PD1 + CHO/OKT3/PD-L1

| Description | SEQ ID NO | Jurkat/IL2/PD-1 + CHO/OKT3/ PD-L1 Assay (RLU at 12.5 nM) |
|---|---|---|
| PD-1 variant Fc: PD-1 (6-127) variant - GSG4S - Fc | 489 | 554 |
| ICOSL/PD-1 Stack 1: ICOSL variant IgV - 3xG4S - PD-1(6-127) variant - GSG4S - Fc | 477 | 4214 |
| ICOSL/PD-1 Stack 2: PD-1 (6-127) variant - 3xG4S - ICOSL variant IgV - GSG4S - Fc | 478 | 3835 |
| ICOSL/PD-1 Stack 3: ICOSL variant IgV - 3xG4S - PD-1 (6-127) variant - GSG4S - Fc | 479 | 1907 |
| ICOSL/PD-1 Stack 4: PD-1 (6-127) variant - 3xG4S - ICOSL variant IgV - GSG4S - Fc | 480 | 3162 |
| ICOSL/PD-1 Stack 5: ICOSL variant IgV - 3xG4S - PD-1(6-127) variant - GSG4S - Fc | 481 | 2059 |
| ICOSL/PD-1 Stack 6: PD-1(6-127) variant - 3xG4S - ICOSL variant IgV - GSG4S - Fc | 482 | 557 |
| ICOSL/PD-1 Stack 7: ICOSL variant IgV - 3xG4S - Wild-type PD-1(6-127) - GSG4S - Fc | 483 | 454 |

TABLE E13B-continued

Jurkat Costimulation Assay with PD1 blockade:
Jurkat/IL2/PD1 + CHO/OKT3/PD-L1

| Description | SEQ ID NO | Jurkat/IL2/PD-1 + CHO/OKT3/ PD-L1 Assay (RLU at 12.5 nM) |
|---|---|---|
| ICOSL/PD-1 Stack 8: Wild-type PD-1 (6-127)- 3xG4S - ICOSL variant IgV - GSG4S - Fc | 484 | 327 |
| ICOSL/PD-1 Stack 9: ICOSL variant IgV - 3xG4S - Wild-type PD-1 (6-127)- GSG4S - Fc | 485 | 408 |
| ICOSL/PD-1 Stack 10: ICOSL variant IgV - 3xG4S - Wild-type PD-1 (6-127) - GSG4S - Fc | 486 | 202 |
| ICOSL/PD-1 Stack 11: Wild-type PD-1 (6-127) - 3xG4S - ICOSL variant IgV - GSG4S - Fc | 487 | 151 |
| Wild-type PD-1 Fc Wild-type PD-1 (6-127)- GSG4S - Fc | 488 | 160 |
| Anti-PD-L1 antibody (atezolizumab) | — | 584 |
| Anti-PD-L1 antibody (durvalumab) | — | 596 |
| hIgG1 | — | 182 |

Example 13

Generation and Selection of Additional Affinity Modified PD-1 Molecules Using Degenerate Libraries Additional mutant DNA constructs encoding a variant PD-1 for translation except two degenerate libraries were used as described below with constructs generated based on the wildtype-human PD-1 (6-127) sequence set forth in SEQ ID NO: 392 containing an IgV domain.

Degenerate codons, used for site-specific partial or complete randomization, were generated as mixed base sets using an algorithm at the URL: rosettadesign.med.unc.edu/SwiftLib/.

In general, PD-1 positions targeted for mutation were chosen based on hotspot information obtained after two rounds of affinity maturation of random libraries, as well as through careful inspection of the available crystal structure information for PD-L1::PD-1 complex (e.g., PDB: 4ZQK) and PD-L2::PD-1 complex (e.g., PDB: 3BP5). All protein structures were viewed using PyMOL by Schrödinger (available at the URL: https://www.schrodinger.com/pymol) to identify interfacial residues for mutagenesis with degenerate codons.

Interface residues were selected based on their proximity to Ala121 of PD-L1, which corresponds to Trp110 of PD-L2, because this region is distinct between the two molecules, in contrast to the remainder of their PD-1 binding surfaces, which show highly similar overall architecture. To engineer PD-1 molecules with improved PD-L1 binding and specificity over PD-L2, the following eight positions were selected because their side chains were pointed toward the binding interface, and predicted to be within 5 Å of Trp110 of PD-L2: V44, L45, N46, G104, A105, I106, L108, and I114. Since eight NNK positions corresponds to a theoretical diversity of >$10^{10}$, these eight positions were separated into two different NNK libraries as set forth in Table E14A.

TABLE E14A

Generation of Degenerate Libraries

| Library | Position | Wildtype Residue | Desired Substitutions | Codon | Actual Substitutions |
|---|---|---|---|---|---|
| 1 | 73 | C | C, R, A, S | BSY | C, R, A, S, G, P |
|   | 86 | F | Y, F | TWY | F, Y |
|   | 104 | G | All | NNK | All |
|   | 106 | I | All | NNK | All |
|   | 107 | S | T, S | WCY | S, T |
|   | 108 | L | All | NNK | All |
|   | 112 | A | V | GTG | V |
|   | 114 | I | All | NNK | All |
|   | 115 | K | D, E, N | RAW | D, E, K, N |
|   | 119 | R | R, W, L, Q | YDG | STOP, Q, R, W, L |
|   | 120 | A | V, A | GYY | A, V |
| 2 | 44 | V | All | NNK | All |
|   | 45 | L | All | NNK | All |
|   | 46 | N | All | NNK | All |
|   | 73 | C | C, R, A, S | BSY | C, R, A, S, G, P |
|   | 86 | F | Y, F | TWY | F, Y |
|   | 105 | A | All | NNK | All |
|   | 107 | S | T, S | WCY | S, T |
|   | 112 | A | V | GTG | V |
|   | 115 | K | D, E, N | RAW | D, E, K, N |
|   | 119 | R | R, W, L, Q | YDG | STOP, Q, R, W, L |
|   | 120 | A | V, A | GYY | A, V |

In additional to the NNK positions, several mixed base sets were included at positions that were identified as hotspots following two generations of affinity maturation of the random PD-1 libraries. Mixed base sets were designed to accommodate multiple residues based on the distribution of amino acid substitutions at any one hotspot. The significance of amino acid substitutions was quantified by calculating mutation propensity scores at every position. The binding affinity between PD-1 and PD-L1 was used as the metric for propensity calculations as follows: The frequency of a given substitution in a hit with a binding affinity in the top 10% divided by the frequency of that same substitution in the entire set of hits. Since this score does not perfectly reflect the importance of a mutation (e.g., a mutation that occurs in 100% of all hit sequences is likely very important for structure or function, yet its propensity score is only 1 vs a maximum score of 10), it was used in conjunction with the total mutational frequency score at the same position to identify a suitable set of residues for partial randomization. In addition to these considerations, the number of positions and the number of mutations in a position were limited to keep the theoretical diversity of a degenerate codon library to ~$10^8$ unique clones.

Based on this hotspot analysis, six positions were chosen for mutation using mixed base sets, and one position was substituted with a single substitution codon. The codons corresponding to residues C73, F86, S107, A112, K115, R119, and A120 were changed to codons BSY, TWY, WCY, GTG, RAW, YDG, and GYY, respectively. Each codon codes for 1-6 unique amino acids and were included in both of the degenerate NNK libraries that were designed off of the structural considerations described above. Taken together, the theoretical diversity of each degenerate library is slightly over $10^8$. Each degenerate codon library was designed using SnapGene (GSL Biotech LLC, USA) and synthesized as a double-stranded, full-length DNA segment through the BioXp™ Degenerate Library service (SGI-DNA, USA).

The library DNA was introduced into yeast essentially as described in Example 2 to generate yeast libraries. The libraries were used to select yeast expressing affinity modified variants of PD-1 as described in Example 3. Selections were performed essentially as described in Example 3 above except for the final selection. Instead of a standard negative selection, yeast cells displaying PD-1 were first preincubated with 100 nM (1 mL) of PD-L2-Fc for 1 hr, then diluted to 45 mL FBS with 0.25 nM PD-L1-6×His for 1 hr. Cells were then secondary labeled with PE anti-6×His antibody to isolate PD-L1 specific binders. Additional variants identified in the screen as described are set forth in Table E14B.

| Example E14B. Additional Selected PD-1 Variants | |
|---|---|
| PD-1 Mutations | SEQ ID NO |
| C73A/F86Y/S107T/A112V/K115N/R119Q/A120V | 811 |
| C73R/F86Y/A105G/S107T/A112V/K115N/R119L/A120V | 812 |
| N54H/G70E/C73P/F86Y/A112V/K115D/R119L/A120V | 813 |
| C73G/F86Y/S107T/A112V/K115N/R119Q/A120V | 814 |
| N54S/C73G/F86Y/S107T/A112V/K115D/R119L/A120V | 815 |
| F86Y/S107T/A112V/K115D/R119W/A120V | 816 |
| G70E/C73P/F86Y/S107T/A112V/K115E/R119Q/A120V | 817 |
| C73G/F86Y/A105G/S107T/A112V/K115D/R119W | 818 |
| C73G/F86Y/S107T/A112V/K115D/R119L/A120V | 819 |
| C73S/F86Y/S107T/A112V/K115D/R119L/A120V | 820 |
| L45V/C73G/F86Y/G104A/S107T/A112V/K115N/R119W/A120V | 821 |
| C73P/F86Y/S107T/A112V/K115D/R119Q/A120V | 822 |
| C73S/F86Y/S107T/A112V/K115E/R119Q/A120V | 823 |
| C73S/F86Y/G104T/S107T/A112V/K115E/R119W/A120V | 824 |
| C73R/F86Y/S107T/K111R/A112V/K115D/A120V | 825 |
| P14L/C73G/F86Y/S107T/A112V/K115D/R119L/A120V | 826 |
| G70E/F86Y/S107T/A112V/K115D/R119L/A120V | 827 |
| C73G/F86Y/G104V/S107T/A112V/K115N/R119L/A120V | 828 |
| C73S/F86Y/G104S/S107T/L108F/A112V/K115D/R119L/A120V | 829 |
| C73S/F86Y/S107T/A112V/K115D/A120V | 830 |
| C73R/F86Y/S107T/A112V/K115D/R119L/A120V | 831 |
| C73S/F86Y/S107T/A112V/Q113R/K115D/R119L/A120V | 832 |
| C73S/F86Y/V91A/S107T/A112V/K115D/R119L/A120V | 833 |
| G70E/C73P/F86Y/A105G/S107T/A112V/K115D/R119Q/A120V | 834 |
| C73G/F86Y/A105G/S107T/A112V/K115D/R119L/A120V | 835 |
| C73G/F86Y/A105G/S107T/A112V/Q113R/K115D/R119L/A120V | 836 |
| F86Y/S107T/A112V/K115D/R119Q/A120V | 837 |
| C73R/F86Y/S107T/A112V/K115N/R119L/A120V | 838 |
| C73A/F86Y/S107T/A112V/Q113R/K115E/R119Q/A120V | 839 |
| C73R/F86Y/S107T/A112V/K115D/R119Q/A120V | 840 |
| C73G/F86Y/A112V/K115D/R119W/A120V | 841 |
| C73P/F86Y/A105G/S107T/A112V/Q113R/K115D/R119L/A120V | 842 |
| C73R/F86Y/A105G/S107T/A112V/K115D/R119L/A120V | 843 |
| C73A/F86Y/S107T/A112V/K115D/R119L/A120V | 844 |
| P69S/C73R/F86Y/S107T/A112V/K115D/R119W/A120V | 845 |
| C73S/F86Y/G104S/S107T/A112V/K115E/R119W/A120V | 846 |
| Q68R/C73S/F86Y/S107T/A112V/K115D/R119Q/A120V | 847 |
| C73R/F86Y/S107T/A112V/K115N/R119Q/A120V | 848 |
| G70E/C73R/F86Y/S107T/A112V/K115N/R119Q/A120V | 849 |
| C73S/F86Y/S107T/A112V/K115D/R119W/A120V | 850 |
| G70E/F86Y/G104T/I106L/S107T/L108T/A112V/K115N/R119L/A120V | 851 |
| C73H/F86Y/A105G/S107T/A112V/K115D/R119L/A120V | 852 |
| G70E/C73P/F86Y/A105C/S107T/A112V/K115D/R119L/A120V | 853 |
| G70E/C73P/F86Y/S107T/A112V/K115D/R119Q/A120V | 854 |
| C73S/F86Y/S107T/K111R/A112V/K115E/R119L/A120V | 855 |
| C73R/D85G/F86Y/A105G/S107T/A112V/K115D/R119Q/A120V | 856 |
| C73R/F86Y/S107T/A112V/K115E/R119W/A120V | 857 |
| N54S/C73G/F86Y/S107T/A112V/K115E/R119Q/A120V | 858 |
| C73S/F86Y/G104S/S107T/A112V/K115N/R119L/A120V | 859 |
| F17L/Q71R/C73G/F86Y/A105G/S107T/A112V/K115D/R119L/A120V | 860 |
| C73G/F86Y/S107T/A112V/K115E/R119W/A120V | 861 |
| G70E/C73G/F86Y/A105C/S107T/A112V/K115E/R119L/A120V | 862 |
| C73G/F86Y/G104A/S107T/A112V/K115D/R119W/A120V | 863 |
| C73S/F86Y/S107T/A112V/K115N/A120V | 864 |
| C73P/F86Y/S107T/A112V/K115N/R119L/A120V | 865 |
| W12R/F86Y/S107T/A112V/K115D/R119Q/A120V | 866 |
| G70E/C73G/F86Y/A105L/A112V/K115N/R119Q/A120V | 867 |
| F86Y/S107T/A112V/K115N/R119W/A120V | 868 |

Example 14

Generation of Variant PD-1 Transmembrane Immunomodulatory Proteins with Costimulatory Intracellular Signaling Domains (PD-1 Switch-TIPs)

Transmembrane immunomodulatory proteins (TIPs) with costimulatory intracellular signaling domains (switch-TIPs) were generated containing, in order from N-terminus to C-terminus: a variant or wild-type PD-1 extracellular domain (ECD), a transmembrane domain (TMD); and an intracellular signaling domain (ICD) with a costimulatory signaling domain, such as a costimulatory signaling domain from CD28 (SEQ ID NO:615), ICOS (SEQ ID NO:992) or 41BB (SEQ ID NO:613). In the exemplary generated constructs, the TMD was a transmembrane domain portion of the costimulatory signaling molecule. The extracellular domain of the constructs also included a spacer, such as a hinge region from CD8 (SEQ ID NO: 987) or a variant CD8 with C181S mutation (vCD8; SEQ ID NO:986), between the ECD and TMD. As a control, TIPs also were generated that did not contain an intracellular signaling domain (no ICD) containing a cytoplasmic trailer sequence of RSKS.

Exemplary generated PD-1 switch-TIPS, and the encoding nucleotide sequences of each construct, are summarized in Table E1S.

TABLE E15

Extracellular PD-1 variants with substituted costimulatory domains (PD-1 switch-TIPs)

| Construct ID | ECD (SEQ ID NO) | Spacer (SEQ ID NO) | TMD (SEQ ID NO) | ICD(s) (SEQ ID NO(s)) | DNA SEQ ID NO | Protein SEQ ID NO |
|---|---|---|---|---|---|---|
| PD-1 v201 (vCD8) CD28_CD28 | v201 (453) | CD8 C181S (986) | CD28 (988) | CD28 (615) | 1037 | 993 |
| PD-1 v201 (vCD8) 41BB_41BB | v201 (453) | CD8 C181S (986) | 41BB (989) | 4-1BB (613) | 1038 | 994 |
| PD-1 v201 (vCD8) ICOS_ICOS | v201 (453) | CD8 C181S (986) | ICOS (991) | ICOS (992) | 1039 | 995 |
| PD-1 v201 (vCD8) CD28_CD28/41BB | v201 (453) | CD8 C181S (986) | CD28 (988) | CD28 (615); 4-1BB (613) | 1040 | 996 |
| PD-1 v201 (vCD8) CD28_CD28/ICOS | v201 (453) | CD8 C181S (986) | CD28 (988) | CD28 (615) ICOS (992) | 1041 | 997 |
| PD-1 v201 (vCD8) 41BB_41BB/CD28 | v201 (453) | CD8 C181S (986) | 41BB (989) | 4-1BB (613); CD28 (615) | 1042 | 998 |
| PD-1 v201 (vCD8) 41BB_41BB/ICOS | v201 (453) | CD8 C181S (986) | 41BB (989) | 4-1BB (613) ICOS (992) | 1043 | 999 |
| PD-1 v201 (vCD8) ICOS_ICOS/CD28 | v201 (453) | CD8 C181S (986) | ICOS (991) | ICOS (992); CD28 (615) | 1044 | 1000 |
| PD-1 v201 (vCD8) ICOS_ICOS/41BB | v201 (453) | CD8 C181S (986) | ICOS (991) | ICOS (992); 4-1BB (613) | 1045 | 1001 |
| PD-1 v201 (vCD8) CD28_CD28/ICOS/41BB | v201 (453) | CD8 C181S (986) | CD28 (988) | CD28 (615); ICOS (992); 4-1BB (613) | 1046 | 1002 |
| PD-1 v201 (vCD8) CD28_RSKS | v201 (453) | CD8 C181S (986) | CD28 (988) | RSKS | 1047 | 1003 |
| PD-1 WT (CD8) CD28_CD28 | wt-PD-1 (985) | CD8 (987) | CD28 (988) | CD28 (615) | 1048 | 1004 |
| PD-1 WT (CD8) CD28_CD28/41BB | wt-PD-1 (985) | CD8 (987) | CD28 (988) | CD28 (615); 4-1BB (613) | 1049 | 1005 |
| PD-1 WT (CD8) CD28_CD28/ICOS | wt-PD-1 (985) | CD8 (987) | CD28 (988) | CD28 (615); ICOS (992) | 1050 | 1006 |
| PD-1 WT (CD8) CD28_CD28/ICOS/41BB | wt-PD-1 (985) | CD8 (987) | CD28 (988) | CD28 (615); ICOS (992); 4-1BB (613) | 1051 | 1007 |
| PD-1 WT (CD8) CD28_RSKS | wt-PD-1 (985) | CD8 (987) | CD28 (988) | RSKS | 1052 | 1008 |

TABLE E15-continued

Extracellular PD-1 variants with substituted costimulatory domains (PD-1 switch-TIPs)

| Construct ID | ECD (SEQ ID NO) | Spacer (SEQ ID NO) | TMD (SEQ ID NO) | ICD(s) (SEQ ID NO(s)) | DNA SEQ ID NO | Protein SEQ ID NO |
| --- | --- | --- | --- | --- | --- | --- |
| PD-1 WT (vCD8) CD28_CD28 | wt-PD-1 (985) | CD8 C181S (986) | CD28 (988) | CD28 (615) | 1053 | 1009 |
| PD-1 WT (vCD8) CD28_CD28/41BB | wt-PD-1 (985) | CD8 C181S (986) | CD28 (988) | CD28 (615); 4-1BB (613) | 1054 | 1010 |
| PD-1 WT (vCD8) CD28_CD28/ICOS | wt-PD-1 (985) | CD8 C181S (986) | CD28 (988) | CD28 (615); ICOS (992) | 1055 | 1011 |
| PD-1 WT (vCD8) CD28_CD28/ICOS/41BB | wt-PD-1 (985) | CD8 C181S (986) | CD28 (988) | CD28 (615); ICOS (992); 4-1BB (613) | 1056 | 1012 |
| PD-1 WT (vCD8) CD28_RSKS | wt-PD-1 (985) | CD8 C181S (986) | CD28 (988) | RSKS | 1057 | 1013 |
| PD-1 WT (vCD8) CD28_ICOS | wt-PD-1 (985) | CD8 C181S (986) | CD28 (988) | ICOS (992) | 1058 | 1014 |
| PD-1 WT (vCD8) CD28_41BB | wt-PD-1 (985) | CD8 C181S (986) | CD28 (988) | 4-1BB (613) | 1059 | 1015 |
| PD-1 WT (vCD8) CD28_ICOS/41BB | wt-PD-1 (985) | CD8 C181S (986) | CD28 (988) | ICOS (992) 4-1BB (613) | 1060 | 1016 |
| PD-1 WT (vCD8) CD28_41BB/ICOS | wt-PD-1 (985) | CD8 C181S (986) | CD28 (988) | 4-1BB (613); ICOS (992) | 1061 | 1017 |
| PD-1 v201 (vCD8) CD28_ICOS | v201 (453) | CD8 C181S (986) | CD28 (988) | ICOS (992) | 1062 | 1018 |
| PD-1 v201 (vCD8) CD28_41BB | v201 (453) | CD8 C181S (986) | CD28 (988) | 4-1BB (613) | 1063 | 1019 |
| PD-1 v201 (vCD8) CD28_ICOS/41BB | v201 (453) | CD8 C181S (986) | CD28 (988) | ICOS (992) 4-1BB (613) | 1064 | 1020 |
| PD-1 v201 (vCD8) CD28_41BB/ICOS | v201 (453) | CD8 C181S (986) | CD28 (988) | 4-1BB (613); ICOS (992) | 1065 | 1021 |
| PD-1 v196 (vCD8) CD28_CD28 | v196 (430) | CD8 C181S (986) | CD28 (988) | CD28 (615) | 1066 | 1022 |
| PD-1 v196 (vCD8) CD28_CD28/41BB | v196 (430) | CD8 C181S (986) | CD28 (988) | CD28 (615); 4-1BB (613) | 1067 | 1023 |
| PD-1 v196 (vCD8) CD28_CD28/ICOS | v196 (430) | CD8 C181S (986) | CD28 (988) | CD28 (615); ICOS (992) | 1068 | 1024 |
| PD-1 v196 (vCD8) CD28_CD28/ICOS/41BB | v196 (430) | CD8 C181S (986) | CD28 (988) | CD28 (615); ICOS (992); 4-1BB (613) | 1069 | 1025 |
| PD-1 v196 (vCD8) CD28_ICOS | v196 (430) | CD8 C181S (986) | CD28 (988) | ICOS (992) | 1070 | 1026 |
| PD-1 v196 (vCD8) CD28_41BB | v196 (430) | CD8 C181S (986) | CD28 (988) | 4-1BB (613) | 1071 | 1027 |
| PD-1 v196 (vCD8) CD28_ICOS/41BB | v196 (430) | CD8 C181S (986) | CD28 (988) | ICOS (992); 4-1BB (613) | 1072 | 1028 |
| PD-1 v196 (vCD8) CD28_41BB/ICOS | v196 (430) | CD8 C181S (986) | CD28 (988) | 4-1BB (613); ICOS (992) | 1073 | 1029 |
| PD-1 v196 (vCD8) 41BB_41BB | v196 (430) | CD8 C181S (986) | 41BB (989) | 4-1BB (613) | 1074 | 1030 |
| PD-1 v196 (vCD8) ICOS_ICOS | v196 (430) | CD8 C181S (986) | ICOS (991) | ICOS (992) | 1075 | 1031 |

TABLE E15-continued

Extracellular PD-1 variants with substituted costimulatory domains (PD-1 switch-TIPs)

| Construct ID | ECD (SEQ ID NO) | Spacer (SEQ ID NO) | TMD (SEQ ID NO) | ICD(s) (SEQ ID NO(s)) | DNA SEQ ID NO | Protein SEQ ID NO |
|---|---|---|---|---|---|---|
| PD-1 v196 (vCD8) CD28_RSKS | v196 (430) | CD8 C181S (986) | CD28 (988) | RSKS | 1076 | 1032 |
| PD-1 v196 (CD8) CD28_CD28 | v196 (430) | CD8 (987) | CD28 (988) | CD28 (615) | 1077 | 1033 |
| PD-1 v196 (CD8) CD28_CD28/41BB | v196 (430) | CD8 (987) | CD28 (988) | CD28 (615); 4-1BB (613) | 1078 | 1034 |
| PD-1 v196 (CD8) CD28_CD28/ICOS | v196 (430) | CD8 (987) | CD28 (988) | CD28 (615); ICOS (992) | 1079 | 1035 |
| PD-1 v196 (CD8) CD28_CD28/ICOS/41BB | v196 (430) | CD8 (987) | CD28 (988) | CD28 (615); ICOS (992); 4-1BB (613) | 1080 | 1036 |
| PD-1 v201 (vCD8) 41BB_41BB | v201 (453) | CD8 C181S (986) | 41BB (989) | 4-1BB (990) | 1085 | 1081 |
| PD-1 v201 (vCD8) CD28_CD28/41BB | v201 (453) | CD8 C181S (986) | CD28 (988) | CD28 (615); 4-1BB (990) | 1086 | 1082 |
| PD-1 v201 (vCD8) 41BB_41BB/CD28 | v201 (453) | CD8 C181S (986) | 41BB (989) | 4-1BB (990); CD28 (615) | 1087 | 1083 |
| PD-1 v201 (vCD8) ICOS_ICOS/41BB | v201 (453) | CD8 C181S (986) | ICOS (991) | ICOS (992); 4-1BB (990) | 1088 | 1084 |

Example 15

Assessment of Variant PD-1 Transmembrane Immunomodulatory Proteins (PD-1 TIPs) with Costimulatory Intracellular Signaling Domains (PD-1 Switch-TIPS) on TCR-Expressing Cells The activity of exemplary PD-1 switch-TIPs, as described in Example 14, on T cell responses of T cells engineered with an exemplary recombinant HPV E6-specific T cell receptor (TCR) was assessed.

(A) Lentiviral Transduction

Primary human T cells were isolated and activated by incubation with anti-CD3/anti-CD28 magnetic beads. One day later, cells were transduced by two lentiviral vectors. Inserted in the first vector was a polynucleotide encoding TCRα and TCRβ chain sequence of a TCR specific to HPV E6 (described in WO 2015/009606) separated by a self-cleaving peptide (e.g., T2A or P2A). Inserted in the second vector was a polynucleotide encoding the PD-1 switch-TIP as described in Example 14. As a control, T cells were transduced only by the lentivirus expressing the E6 TCR.

Two days after initiation of transduction the anti-CD3/anti-CD28 beads were removed and recombinant IL-2 was added. The cells were then incubated for an additional seven days and then were harvested for assessment of activity. Transduction efficiency of the switch-TIP lentivirus was confirmed by eGFP signal. Surface expression of the E6 TCR and switch-TIP was confirmed by flow cytometry. Transduced T cells had similar levels of TCR expression as confirmed by flow cytometry. Activity was assessed against HPV+ tumor cells lines via proliferation, cytokine production (IFN-gamma, TNF-alpha and IL-2) and cytotoxicity.

(B) Functional Activity

Engineered T cells were co-cultured with HPV-infected cells epidermoid carcinoma CaSki cells (ATCC® No. CRL-1550™; HPV+, HLA-A2+) at various effector cell to target cell (E:T) ratios. The Caski cells constitutively expressed firefly luciferase. After 24 hours incubation, cytotoxicity was measured by loss of luciferase signal and supernatants were collected for evaluation of TNF-alpha release by Luminex analysis.

Figure 6A:
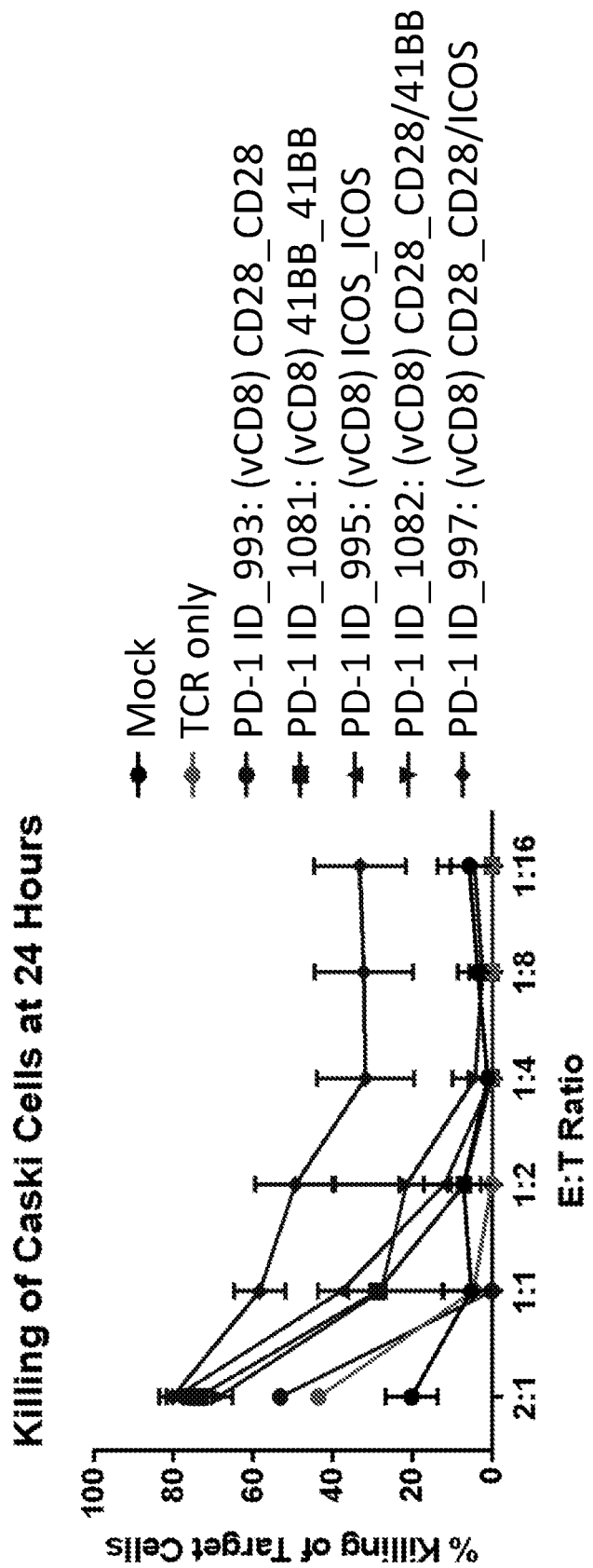
FIG. 6A depicts the killing activity of E6 TCR-engineered T cells expressing a TCR alone (TCR only) or T cells co-expressing an E6 TCR and PD-1 switch-TIP against Caski cells following a 24 hours co-culture at various effector to target ratios (E:T ratio). Killing activity of "Mock" T cells lacking both an HPV16 E6 T cell receptor and a switch-TIP also are shown. Reference to the SEQ ID NO (ID) of the PD-1 TIP is indicated.
Figure 6B:
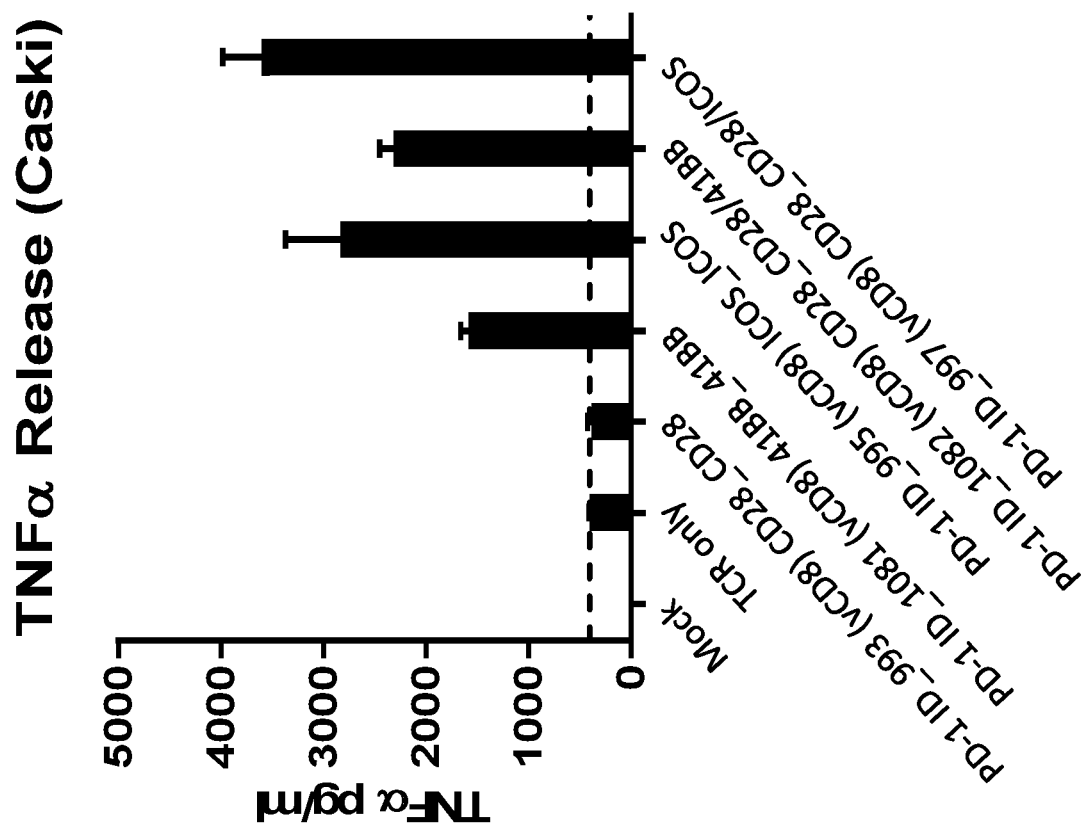
FIG. 6B depicts TNF-alpha (TNFα) release in supernatant 24 hours after co-culture of Caski target cells and E6 TCR-engineered T cells expressing a TCR alone or co-expressing an indicated PD-1 switch-TIP. The dashed line corresponds to the TNFα level of Caski cells incubated with the TCR-only T cells. The PD-1 switch receptors used were as described in the description of FIG. 6A. Reference to the SEQ ID NO (ID) of the PD-1 TIP is indicated.

FIGS. 6A and 6B show results for HPV-target cell killing and cytokine production, respectively, for exemplary generated PD-1 switch-TIPs. TCR-engineered T cells co-expressing switch-TIPs enhanced killing of target cells (FIG. 6A) and cytokine production (FIG. 6B) over TCR-alone engineered T cells. The killing activity was observed with various combinations of intracellular signaling domains. The activity was consistently superior to activity of TCR-engineered T cells co-expressing a TIP without an ICD or a switch-TIP containing a wild-type extracellular PD-1 domain.

Figure 7A:
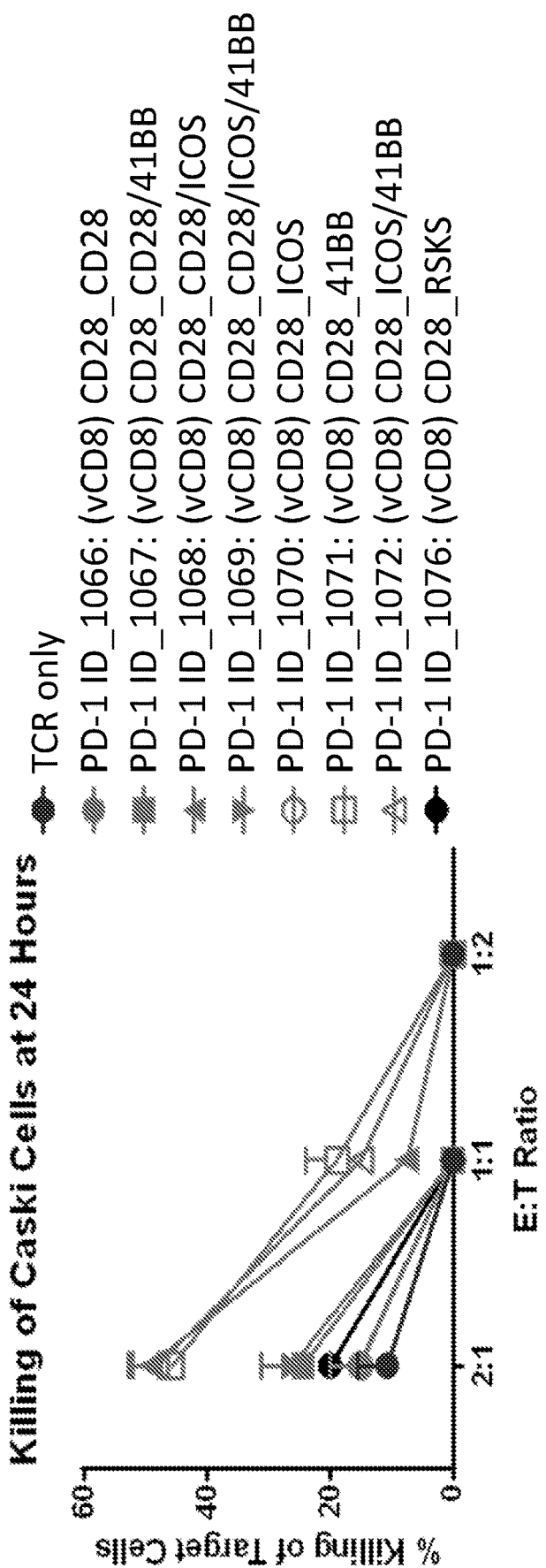
FIG. 7A depicts killing activity of E6 TCR-engineered T cells expressing a TCR alone or co-expressing an indicated PD-1 switch-TIP against Caski cells following a 24 hours co-culture at various effector to target ratios (E:T ratio). Reference to the SEQ ID NO (ID) of the PD-1 TIP is indicated.
Figure 7C:
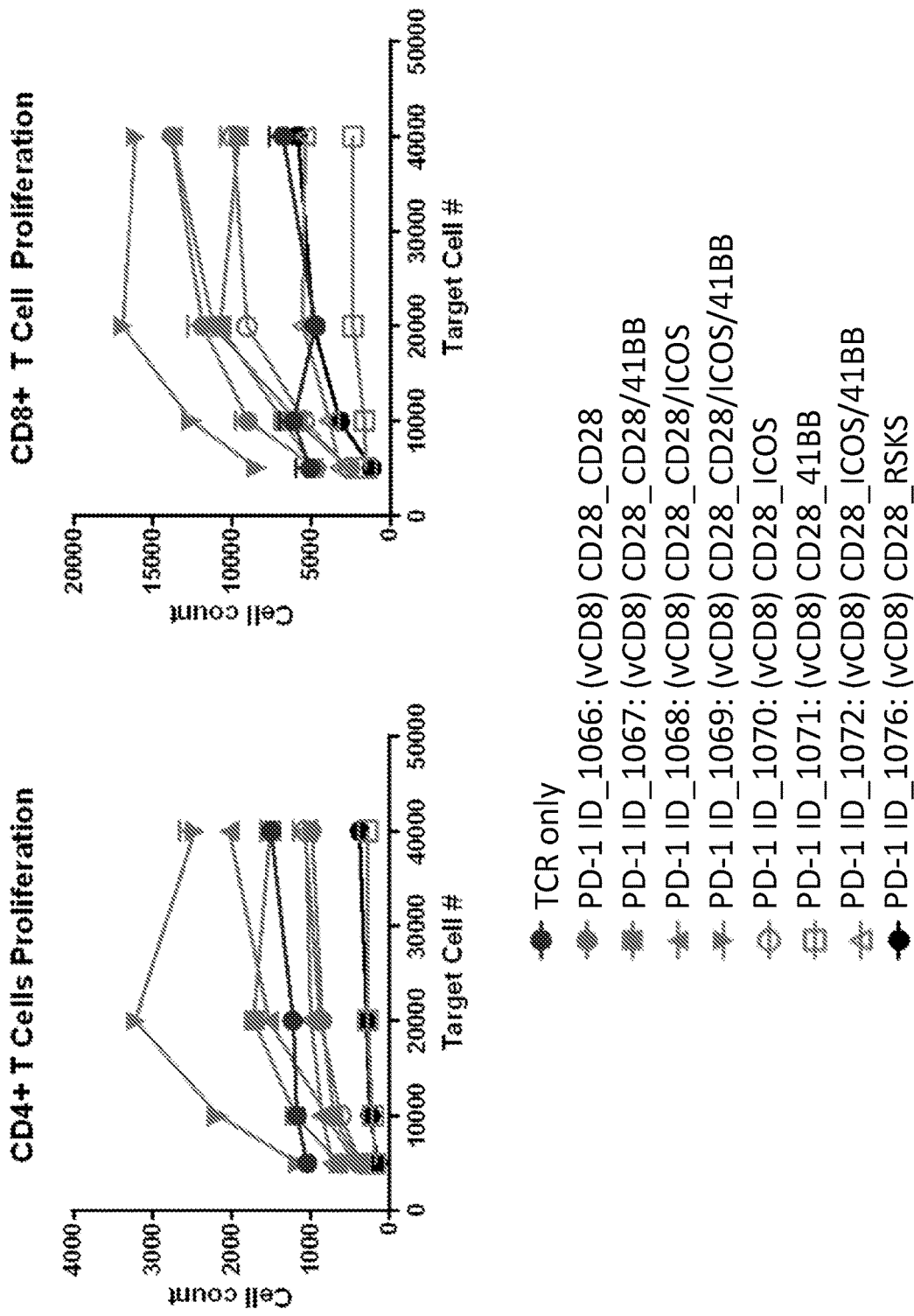
FIG. 7C depicts CD4+ or CD8+ T cell proliferation 3 days after initiation of co-culture of E6 TCR-engineered T cells expressing a TCR alone or co-expressing an indicated PD-1 switch-TIP with Caski target cells, as determined by CD4+ or CD8+ T cell count as a function of target cells. Reference to the SEQ ID NO (ID) of the PD-1 TIP is indicated.
Figure 9A:
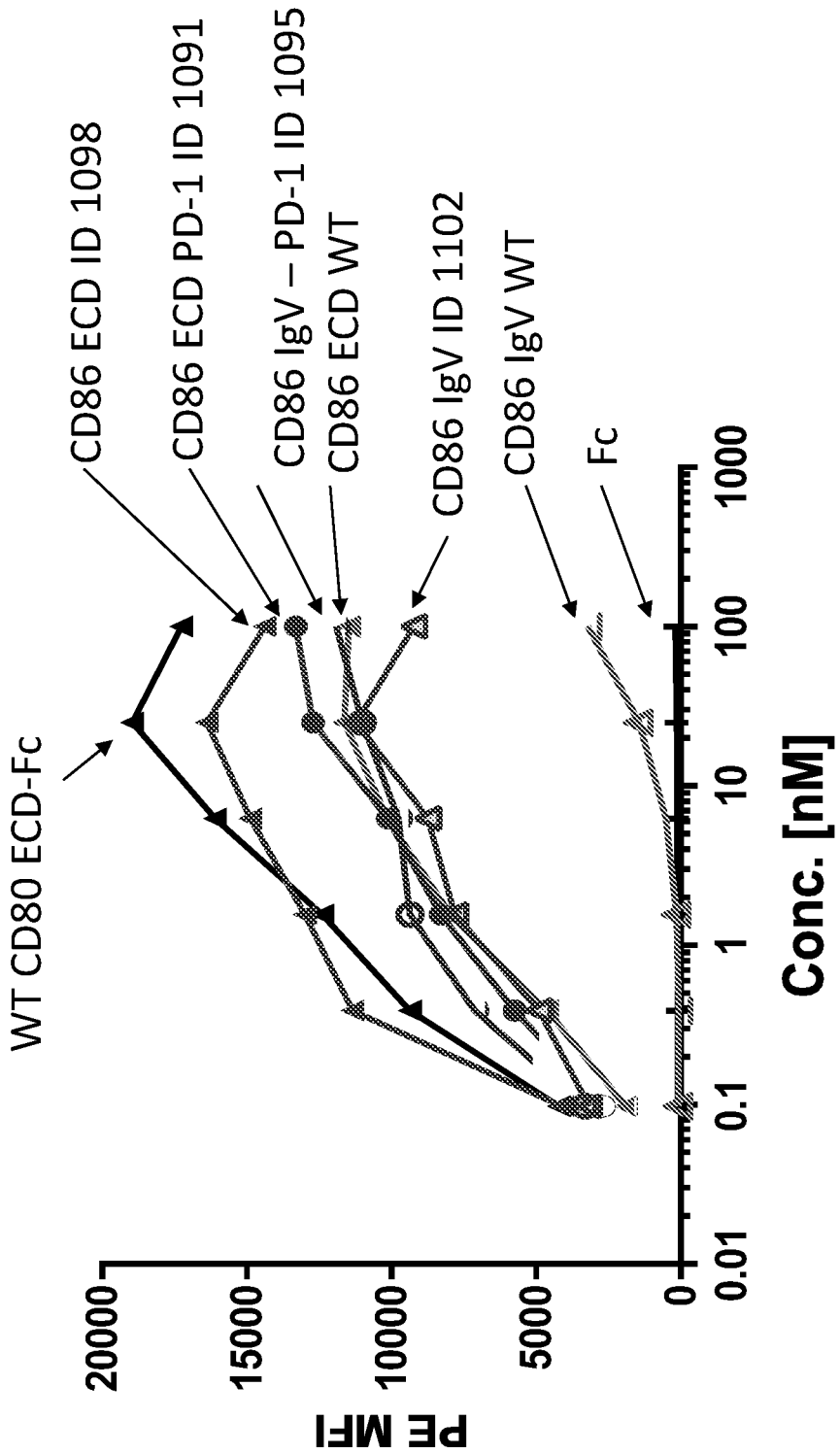
Figure 10:
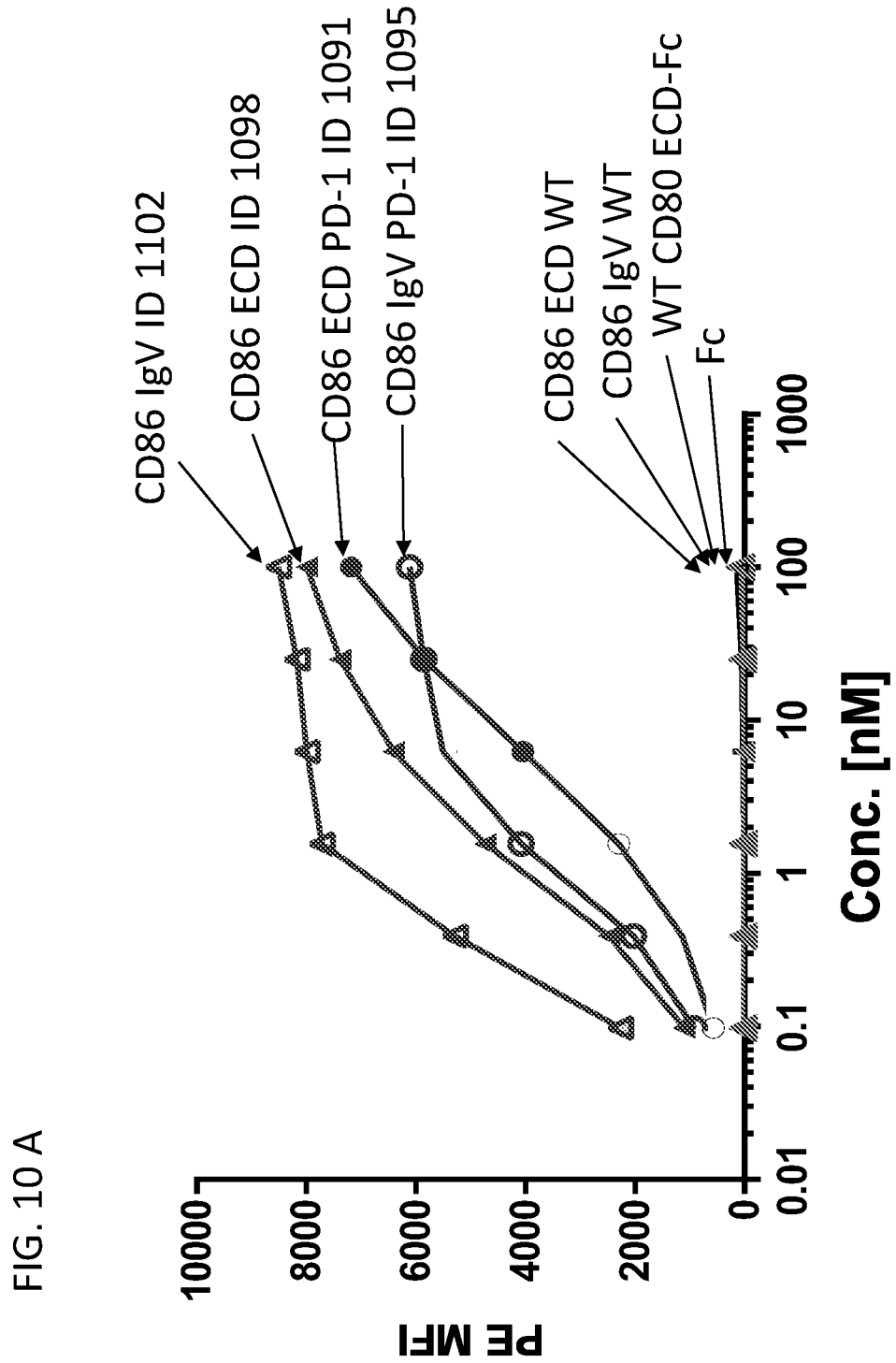
FIG. 10A and FIG. 10B depict binding of exemplary PD1-CD86 stack constructs at various concentrations (0.1 nM to 100 nM) to cognate binding partner CD28, determined by mean Fluorescence Intensity (MFI) assessed by flow cytometry.
Figure 10:
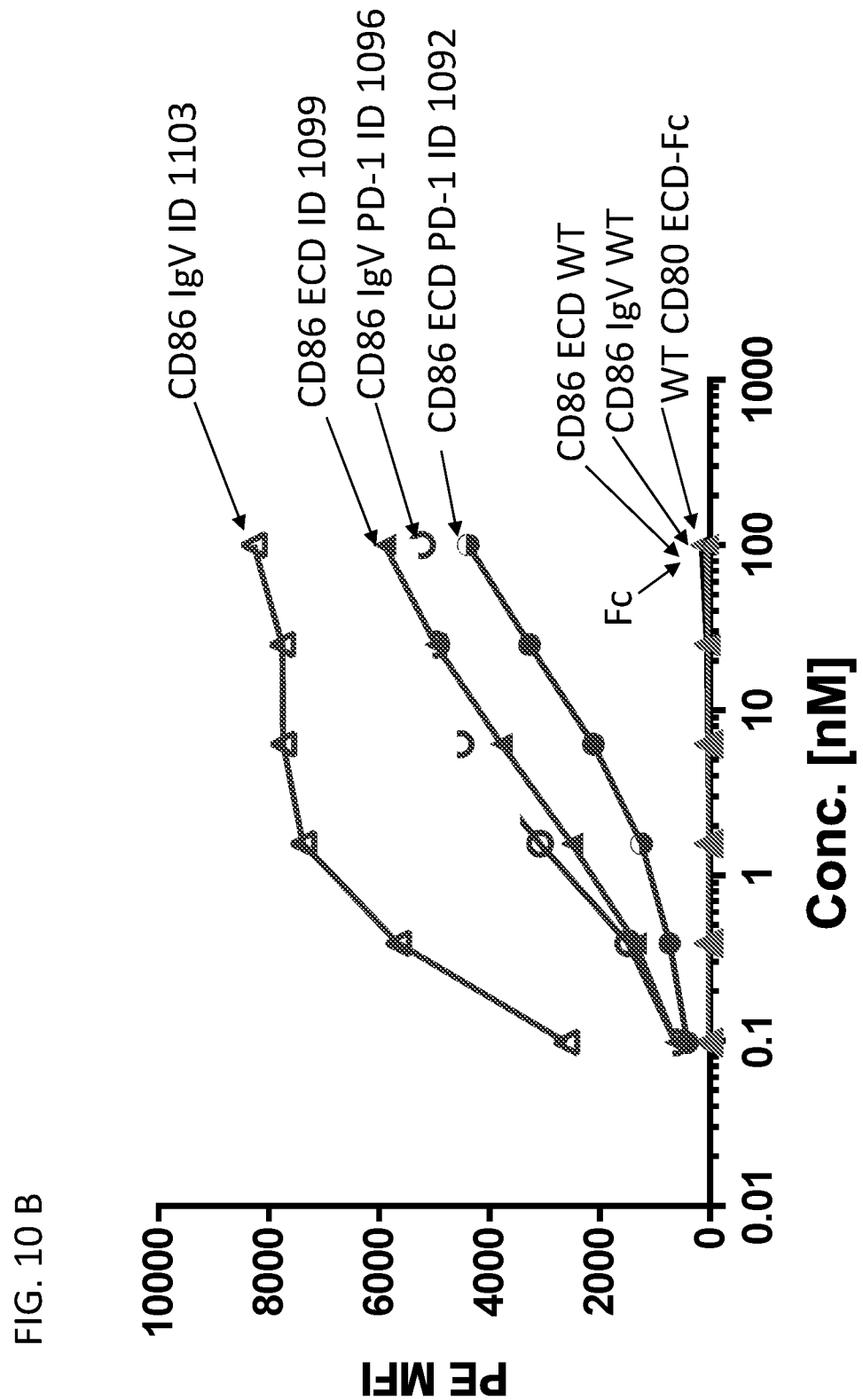
Figure 11:
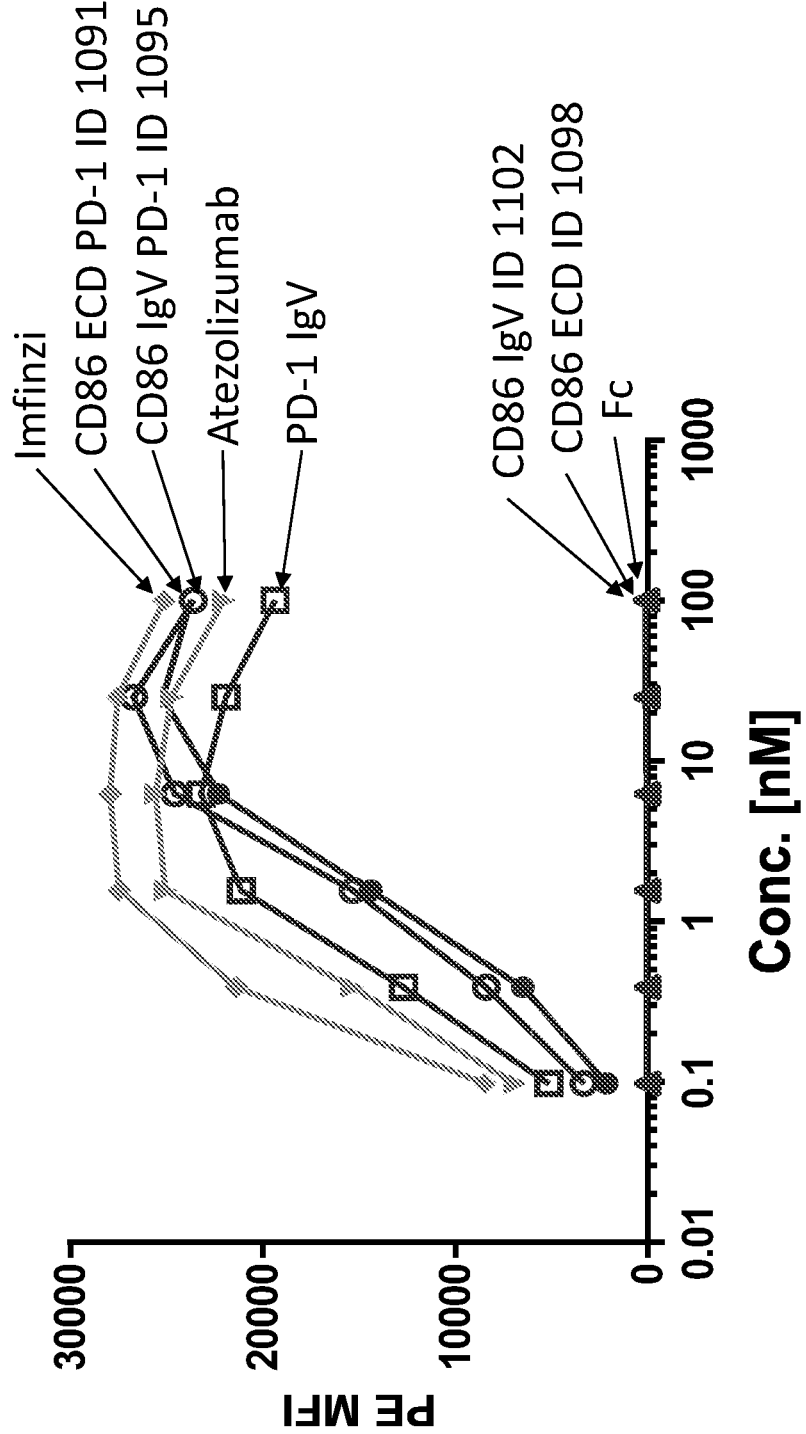
FIG. 11A and FIG. 11B depict binding of exemplary PD1-CD86 stack constructs at various concentrations (0.1 nM to 100 nM) to cognate binding partner PD-L1, determined by mean Fluorescence Intensity (MFI) assessed by flow cytometry.
Figure 11:
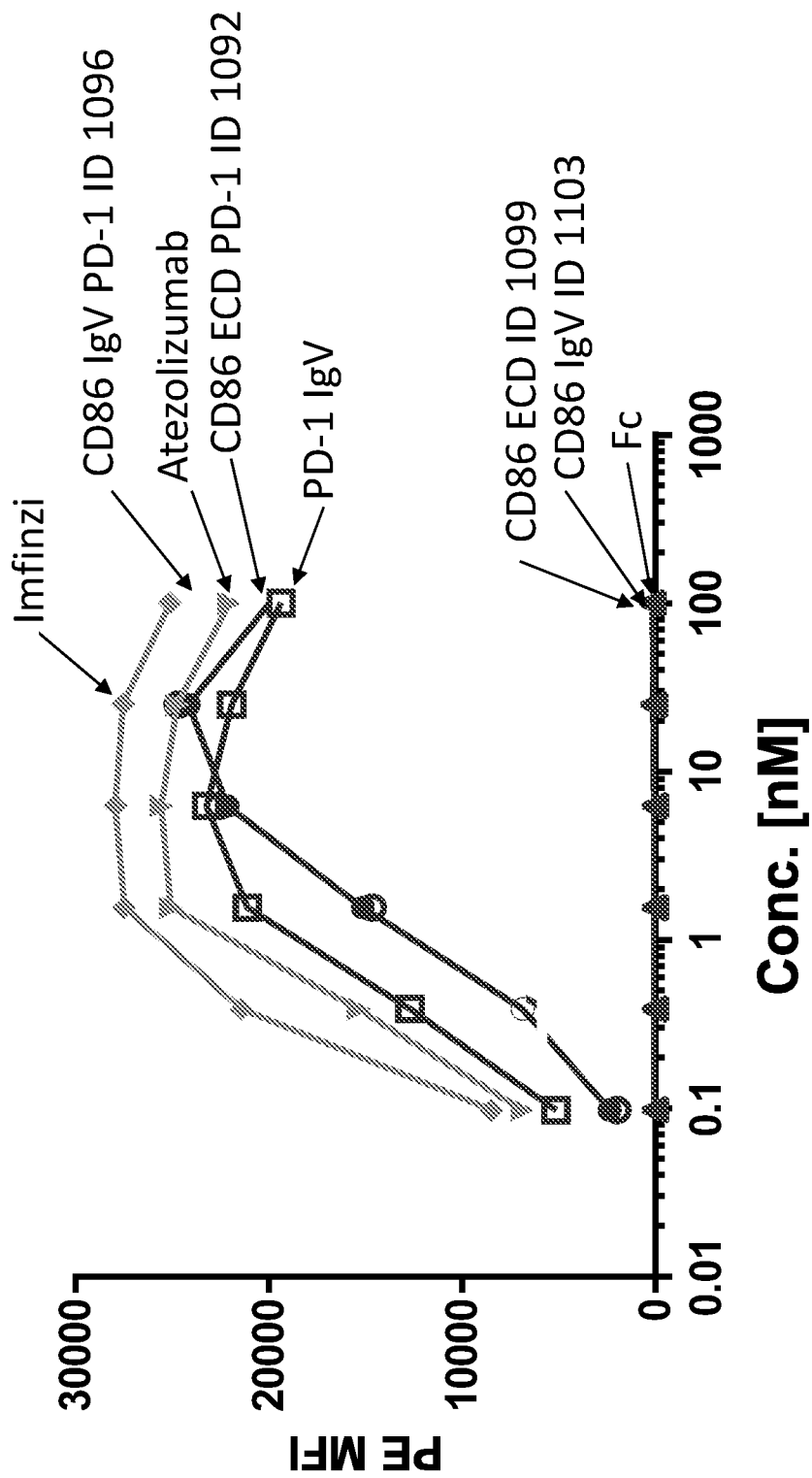

Activity of engineered TCR-expressing T cells co-expressing additional exemplary PD-1 switch-TIPs was assessed by monitoring proliferation, cytokine production and cytotoxicity following co-culture with the Caski HPV+ tumor cell line. Killing activity across a range of E:T ratios is shown in FIG. 7A. Cytokine production of TNF-alpha and IFN-gamma in supernatant 24 hours after co-culture of targets cells and assessed engineered T cells is shown in FIG. 7B. The number of T cells evaluated in co-cultures 3 days after initiation of incubation with HPV+ target cells is shown in FIG. 7C. These results indicate different intracellular signaling domains have the potential to impact different downstream readouts, such as killing, proliferation, and/or cytokine production.

Example 16

Generation of Mutant DNA Constructs of CD86 IgSF Domains

This Example describes the generation of mutant DNA constructs of human CD86 IgSF domains for translation and expression on the surface of yeast as yeast display libraries, introduction of DNA libraries into yeast, and selection of yeast cells expressing affinity-modified variants of CD86 ECD.

Constructs were generated based on a wildtype human CD86 sequence set forth in SEQ ID NO: 29 containing the extracellular domain (ECD; corresponding to residues 24-247 as set forth in UniProt Accession No. P42081), designated "CD86 ECD (24-247)" as follows:

```
CD86 ECD(24-247) (SEQ ID NO: 29):
APLKIQAYFNETADLPCQFANSQNQSLSELVVFWQDQENLVLNEVYLGKE

KFDSVHSKYMGRTSFDSDSWTLRLHNLQIKDKGLYQCIIHHKKPTGMIRI

HQMNSELSVLANFSQPEIVPISNITENVYINLTCSSIHGYPEPKKMSVLL

RTKNSTIEYDGVMQKSQDNVTELYDVSISLSVSFPDVTSNMTIFCILETD

KTRLLSSPFSIELEDPQPPPDHIP
```

Random DNA libraries were constructed to identify variants of the ECD of CD86 set forth in SEQ ID NO: 29. DNA encoding the wild-type ECD domain was cloned between the BamHI and KpnI sites of the modified yeast expression vector PBYDS03 (Life Technologies USA) which places the CD86 ECD N-terminal to the yeast surface anchoring domain Sag1 (the C-terminal domain of yeast α-agglutinin) with an in-frame HA fusion tag N-terminal to the CD86 ECD sequence and a c-Myc fusion tag C-terminal to the CD86 ECD sequence. Expression in this vector is driven off of the inducible gal-1 promoter. After verification of the correct DNA sequence, and proper display of the wild-type CD86 ECD protein on the yeast surface, the wild type DNA construct was used as template for error-prone PCR to introduce random mutations across the CD86 ECD sequence. After error-prone PCR, the mutagenized CD86 ECD DNA was gel purified and then PCR amplified using primers containing 40 bp overlap regions homologous to the upstream sequence of BamHI and the downstream sequence of KpnI in pBYDS03 for preparation of large scale yeast electroporation. The gel-purified, mutated CD86 ECD DNA insert was resuspended in sterile, deionized water.

The mutated CD86 library DNA was inserted into electroporation-competent BJ5464 yeast cells (ATCC) along with BamHI and KpnI digested pBYDS03 vector DNA by electroporation using a BTX ECM399 electroporation system at 2500V. Library size was determined by plating serial dilutions of freshly recovered cells on SCD-Leu agar plates. The remainder of the electroporated culture was grown to saturation under selection in SCD-Leu selection medium. Cells from this culture were subcultured 1/100 into the same medium once more and grown to saturation to minimize the fraction of untransformed cells and to allow for segregation of plasmid from cells that may contain two or more library variants. To maintain library diversity, this subculturing step was carried out using an inoculum that contained at least 10× more cells than the calculated library size. Cells from the second saturated culture were resuspended in fresh medium and frozen and stored at −80° C. (frozen library stock).

Cells from the library were thawed from individual library stocks and grown overnight. The next day cells were resuspending in galactose containing induction media (SCDG-Leu media) and grown overnight at 30° C. to induce expression of library proteins on the yeast cell surface. One liter of SCDG-Leu induction media contained 5.4 grams $Na_2HPO_4$, 8.56 grams $NaH_2PO_4 \cdot H_2O$, 20 grams galactose, 2.0 grams dextrose, 6.7 grams yeast nitrogen base, and 1.6 grams yeast synthetic drop out media supplement without leucine dissolved in water and sterilized through a 0.22 μm membrane filter device.

10× induced library cells were sorted once using Protein A magnetic beads (New England Biolabs, USA) loaded with CD28-Fc to reduce non-binders and enrich for all CD86 ECD variants with the ability to bind their exogenous recombinant counter-structure proteins. This was then followed by three rounds of positive CD28 selection by protein staining with decreasing concentrations of CD28-Fc (20 nM, 1 nM or 250 pM) and fluorescence activated cell sorting (FACS) to enrich the fraction of yeast cells that displayed improved binders. Magnetic bead enrichment and selections by flow cytometry were carried out essentially as described in Miller K. D. et al., Current Protocols in Cytometry 4.7.1-4.7.30, July 2008. Hits were chosen from the third round of positive selection yeast cell outputs described above.

A second cycle of random mutagenesis was carried out from yeast cell outputs from the third round of CD28 positive selected cells. Further hits were chosen following three rounds of FACs positive selection using decreasing concentrations of CD28-Fc as described above. From yeast cell outputs from the third CD28 positive selection, further hits were chosen following a FACs negative CTLA-4 selection after protein staining with 100 nM CTLA-4 Fc.

For screening for functional activity, selected CD86 ECD hit variants were further formatted as Fc fusion proteins.

Output cell pools from selected CD86 FACS sorts were grown to terminal density in SCD-Leu selection medium and plasmid DNA was isolated using a yeast plasmid DNA isolation kit (Zymoresearch, USA). For generation of Fc fusions, the affinity matured CD86 ECD variants were PCR amplified with primers containing 40 bp homologous regions on either end with an AfeI and BamHI digested Fc fusion vector encoding and in-frame with the Fc region to carry out in vitro recombination using Gibson Assembly Master Mix (New England Biolabs). The Gibson Assembly reaction was added to the *E. coli* strain NEB5alpha (New England Biolabs, USA) for heat shock transformation following the manufacturer's instructions.

Dilutions of transformation reactions were plated onto LB-agar containing 100 μg/mL carbenicillin (Teknova, USA) to isolate single colonies for selection. Generally, up to 96 colonies from each transformation were then grown in 96 well plates to saturation overnight at 37° C. in LB-broth containing 100 μg/mL carbenicillin (Teknova cat #L8112) and a small aliquot from each well was submitted for DNA sequencing to identify mutation(s) in all clones.

After sequence analysis and identification of clones of interest, plasmid DNA was prepared using the MidiPlus kit (Qiagen).

The DNA encoded generated affinity-modified (variant) CD86 Fc fusion proteins as follows: variant CD86 domain followed by a linker of 7 amino acids (GSGGGGS) followed by a human IgG1 effectorless Fc sequence as described in Example 4 above.

Recombinant variant Fc fusion proteins were produced from suspension-adapted human embryonic kidney (HEK) 293 cells using the Expi293 expression system (Invitrogen, USA). Supernatant was harvested and the Fc Protein was captured on Mab SelectSure. (GE Healthcare cat. no.

17543801) Protein was eluted from the column using 50 mM Acetate pH3.6. The MabSelect Sure eluate is pooled and the pH is adjusted to above pH5.0. This material was then polished on a Preparative SEC column, to generate highly purified monomeric material. This material is buffer exchanged into 10 mM Acetate, 9% Sucrose pH 5.0. (A5Su) The protein purity is assessed by analytic SEC. Material is vialed and stored at −80.

Purified Fc-fusion proteins were assayed for binding to CD28 using Jurkat cells or to CTLA-4 using Chinese Hamster Ovary (CHO) cells that were transduced to stably express CTLA-4 (CHO/CTLA-4). For staining by flow cytometry, approximately 100,000 ligand-expressing cells were incubated with various concentrations of each candidate CD86 variant Fc fusion protein. Controls included an extracellular domain (ECD) of wild-type CD86 ("Wt CD86-Fc") and an Fc only control. To assess binding, cells were stained with an anti-human Fc secondary antibody (Jackson ImmunoResearch, USA), and samples were analyzed on an LSRII (BD Biosciences, Inc., USA) flow cytometer.

Mean Fluorescence Intensity (MFI) was calculated and compared to binding of wildtype CD86 ECD-Fc control with FlowJo Version 10 (FlowJo Version 10, USA). Results for the binding studies for binding of 11 nM of exemplary tested variant CD86 ECD-Fc fusion molecules for CD28- or CTLA-4- expressing cells are shown in Table E16. The Table also indicates amino acid substitutions in the ECD of the variant CD86 selected in the screening described above. In the Table, the exemplary amino acid substitutions and insertions in the ECD domain are designated by amino acid position number corresponding to amino acid positions in the respective reference unmodified mature CD86 extracellular domain (ECD) sequence set forth in SEQ ID NO:29. The amino acid position is indicated in the middle, with the corresponding unmodified (e.g. wild-type) amino acid listed before the number and the identified variant amino acid substitution listed after the number.

As shown in Table E16, the selections resulted in the identification of a number of CD86 IgSF (e.g. ECD) domain variants that were affinity-modified to exhibit increased binding for CD28. The selected variants, in some cases, exhibited altered (e.g. decreased) binding to CTLA4.

TABLE E16

Binding of CD86 ECD Variants to Cognate Binding Partners

| Mutations | Binding to CD28 on Jurkat Cells(11 nM) | | Binding to CHO/CTLA4 Transfectants (11 nM) | |
|---|---|---|---|---|
| | MFI | Fold Increase over WT CD86 ECD | MFI | Fold Increase over WT CD86 ECD |
| Q25L, T71A, H90Y | 4062 | 286.1 | 20435 | 1.0 |
| Q25L, D53G, E212V | 166 | 11.7 | 23346 | 1.2 |
| Q25L, H90L | 3464 | 243.9 | 16961 | 0.8 |
| N43K, I79N, H90L, I178T, E198D | 11.6 | 0.8 | 13204 | 0.7 |
| A13V, Q25L, H90L, S181P, L197M, S206T | 2235 | 157.4 | 18271 | 0.9 |
| Q25L, Q86R, H90L, K93T, L132M, V148D, S181P, P216H | 1639 | 115.4 | 21502 | 1.1 |
| Q25L, F33I, H90Y, V128A, P141A, E158G, S181P | 1445 | 101.8 | 17459 | 0.9 |
| Q25L, N39D, K80R, Q86R, I88F, H90L, K93T, N123D, N154D | 1928 | 135.8 | 19889 | 1.0 |
| Q25L, H90L, K93T, M97L, T133A, S181P, D215V | 373 | 26.3 | 17275 | 0.9 |
| Q25L, Q86R, H90L, N104S | 3834 | 270.0 | 19636 | 1.0 |
| Q25L, L40M, H90L, L180S, S183P | 2482 | 174.8 | 19802 | 1.0 |
| Q18K, Q25L, F33I, L40S, H90L | 3781 | 266.3 | 18971 | 0.9 |
| Q25L, Q86K, H90L, I137T, S181P | 387 | 27.3 | 19575 | 1.0 |
| Q25L, L77P, H90Y, K153R, V170D, S181P | 15.7 | 1.1 | 18797 | 0.9 |
| Q25L, S28G, F33I, F52L, H90L, Q102H, I178T | 749 | 52.7 | 21177 | 1.0 |
| Q25L, F33I, H90L, K144E, L180S | 1636 | 115.2 | 23546 | 1.2 |
| Q25L, F33I, H90L, K153E, E172G, T192N | 13.2 | 0.9 | 8657 | 0.4 |
| Q25L, F33I, Q86R, H90Y, D175E, I196V, E198D | 528 | 37.2 | 22641 | 1.1 |
| Q25L, V45I, D68N, H90L, S183P, L205S | 466 | 32.8 | 17446 | 0.9 |
| E38V, S114G, P143H | No Protein | | | |
| H90Y, L180S | 11.4 | 0.8 | 6078 | 0.3 |
| H90Y, Y129N | 154 | 10.8 | 17640 | 0.9 |
| I89V, H90L, I193V | 1248 | 87.9 | 22070 | 1.1 |
| K80E, H90Y, H222T, I223F, P224L | No Protein | | | |
| K80M, I88T | 1966 | 138.5 | 18532 | 0.9 |
| K92I, F113S | 369 | 26.0 | 20421 | 1.0 |
| M60K, H90L | 1049 | 73.9 | 17319 | 0.9 |
| Q25L, F33I, H90L | 115 | 8.1 | 20888 | 1.0 |

TABLE E16-continued

Binding of CD86 ECD Variants to Cognate Binding Partners

| Mutations | Binding to CD28 on Jurkat Cells(11 nM) MFI | Fold Increase over WT CD86 ECD | Binding to CHO/CTLA4 Transfectants (11 nM) MFI | Fold Increase over WT CD86 ECD |
|---|---|---|---|---|
| Q25L, F33I, Q86R, H90L, K93T | 1316 | 92.7 | 14705 | 0.7 |
| Q25L, H90L | 1810 | 127.5 | 21873 | 1.1 |
| Q25L, H90L, P185S | 135 | 9.5 | 18546 | 0.9 |
| Q25L, H90L, P185S, P224L | 11.9 | 0.8 | 9355 | 0.5 |
| Q25L, H90L, S179R | 2397 | 168.8 | 23282 | 1.1 |
| Q25L, H90Y, S181P, I193V | 256 | 18.0 | 16648 | 0.8 |
| Q25L, K82T, H90L, T152S, S207P | 1027 | 72.3 | 18161 | 0.9 |
| Q25L, Q86R, H90L, K93T | 1500 | 105.6 | 19777 | 1.0 |
| S28G, H90Y | No Protein | | | |
| CD86 WT ECD-Fc | 14.2 | 1.0 | 20294 | 1.0 |
| Fc only control | 11.4 | 0.8 | 32.9 | 0.0 |

Exemplary CD86 ECD variants identified above were converted to an immunomodulatory protein containing the IgV domain as the only IgSF domain of the molecule. The generated variant IgV constructs were based on a wildtype human CD86 sequence set forth in SEQ ID NO: 1100 containing the IgV domain (corresponding to residues 24-134 as set forth in UniProt Accession No. P42081), designated "CD86 IgV (24-134)" as follows:

```
CD86 IgV (24-134) (SEQ ID NO: 1100):
APLKIQAYFNETADLPCQFANSQNQSLSELVVFWQDQENLVLNEVYLGKE

KFDSVHSKYMGRTSFDSDSWTLRLHNLQIKDKGLYQCIIHHKKPTGMIRI

HQMNSELSVLA
```

The variant CD86 IgV molecules were formatted as Fc fusion proteins and tested for binding to CD28 or CTLA-4 as substantially as described above. Results for the binding studies for binding of 25 nM of exemplary tested variant CD86 IgV-Fc fusion molecules for CD28– or CTLA-4–expressing cells are shown in Table E17. In the Table, the exemplary amino acid substitutions and insertions in the IgV domain are designated by amino acid position number corresponding to amino acid positions in the respective reference unmodified mature CD86 extracellular domain (ECD) sequence set forth in SEQ ID NO:29. The amino acid position is indicated in the middle, with the corresponding unmodified (e.g. wild-type) amino acid listed before the number and the identified variant amino acid substitution listed after the number.

TABLE E17

Binding of CD86 IgV Variants to Cognate Binding Partners

| Mutations | Binding to CD28 on Jurkat Cells (25 nM) MFI | Fold Increase over WT CD86 ECD | Binding to CHO/CTLA4 Transfectants (25 nM) MFI | Fold Increase over WT CD86 ECD |
|---|---|---|---|---|
| A13V, Q25L, H90L | 1370 | 111.4 | 3980 | 1.0 |
| Q25L, H90L, K93T, M97L | 1425 | 115.9 | 4239 | 1.1 |
| Q25L, Q86R, H90L | 1569 | 127.6 | 4940 | 1.3 |
| I89V, H90L | 213 | 17.3 | 1660 | 0.4 |
| M60K, H90L | 20 | 1.6 | 134 | 0.0 |
| Q25L, F33I, H90L | 1383 | 112.4 | 5901 | 1.5 |
| Q25L, H90L | 1194 | 97.1 | 3587 | 0.9 |
| WT CD86 IgV-Fc | 12.3 | 1.0 | 87 | 0.0 |
| WT CD86 ECD-Fc | 12.3 | 1.0 | 3951 | 1.0 |
| Fc control | 10.5 | 0.9 | 35.9 | 0.0 |

Example 17

Generation of Stacked Molecules Containing Variant PD-1 Molecules and Variant CD86 Molecules Variant PD-1 molecules described in Examples 1-4 that were affinity-modified for increased binding to PD-L1 were used to generate "stack" Fc fusion molecules with either a wild-type CD86 extracellular domain (ECD; SEQ ID NO: 29), a wild-type CD86 IgV domain (SEQ ID NO: 1100), or a CD86 ECD or IgV domain affinity-modified for increased binding to CD28 as described in Example 16. Stack constructs were obtained via overlap PCR of CD86 and PD-L1 sequences that encoded the stack in a format that enabled its fusion to Fc by standard Gibson assembly using a Gibson assembly kit (New England Biolabs, USA). The encoding nucleic acid molecule of all stacks was generated to encode a protein designed as follows: a first wild-type or variant CD86 ECD or IgV domain, followed by a 15 amino acid linker composed of three GGGGS(G$_4$S) motifs (SEQ ID NO: 473), followed by a variant PD-1 domain, followed by a GSGGGGS linker (SEQ ID NO: 471), followed by the human IgG1 effectorless Fc sequence set forth in SEQ ID NO: 476 as described above.

Table E18 sets forth exemplary generated CD86-PD-1 Stacks.

TABLE E18

CD86-PD-1 Stacks

| SEQ ID NO of stack construct | IgSF components of Stack Construct | |
|---|---|---|
| | CD86 | PD-1 |
| 1089 | WT CD86 ECD (ECD set forth in SEQ ID NO: 29) | SEQ ID NO: 430 |
| 1090 | CD86 ECD: A13V/Q25L/H90L/S181P/L197M/S206T (ECD set forth in SEQ ID NO: 1097) | SEQ ID NO: 430 |
| 1091 | CD86 ECD: Q25L/H90L/K93T/M97L/T133A/S181P/D215V (ECD set forth in SEQ ID NO: 1098) | SEQ ID NO: 430 |
| 1092 | CD86 ECD: Q25L/Q86R/H90L/N104S (ECD set forth in SEQ ID NO: 1099) | SEQ ID NO: 430 |
| 1093 | CD86 IgV domain (IgV set forth in SEQ ID NO: 1100) | SEQ ID NO: 430 |
| 1094 | CD86 IgV: A13V/Q25L/H90L/S181P/L197M/S206T (IgV set forth in SEQ ID NO: 1101) | SEQ ID NO: 430 |
| 1095 | CD86 IgV: Q25L/H90L/K93T/M97L/T133A/S181P/D215V (IgV set forth in SEQ ID NO: 1102) | SEQ ID NO: 430 |
| 1096 | CD86 IgV: Q25L/Q86R/H90L/N104S (IgV set forth in SEQ ID NO: 1103) | SEQ ID NO: 430 |

Example 18

Assessment of Binding and Activity of Stacked Molecules Containing Variant PD-1 Molecules and Variant CD86 Molecules Exemplary stack constructs were generated substantially as described in Example 17, containing a variant PD-1 IgSF domain (e.g. SEQ ID NO:430) with either a wild-type CD86 extracellular domain (ECD; e.g. SEQ ID NO: 29), a wild-type CD86 IgV domain (e.g. SEQ ID NO: 1100), or a variant CD86 IgSF domain (ECD, e.g. SEQ ID NO: 1097 or 1098 or 1099; or IgV, e.g SEQ ID NO: 1101, 1102 or 1103), and were assessed for binding and activity.

A. Binding

To assess binding to cognate binding partners, cells were transduced to express huCTLA, huCD28 and huPD-L1 full-length mammalian proteins. Cells were incubated with various concentrations (0.1 nM to 100 nM) of the exemplary constructs set forth in Table E18. For comparison, binding of wild-type CD80-Fc was also tested. For binding to PD-L1, binding also was compared to anti-PD-1 antibodies (Imfinzi and Atezolizumab). An Fc only molecule was also tested as a control. Binding was assessed by flow cytometry and mean Fluorescence Intensity (MFI) was determined.

As shown in FIGS. 9A-11B, exemplary PD1-CD86 stack constructs retain binding to CTLA-4, CD28 and PD-L1 compared to molecules containing only individual wild-type or variant IgSF domains. Stack constructs containing mutations Q25L/H90L/K93T/M97L/T133A/S181P/D215V in IgV (SEQ ID NO:1102, e.g. stack set forth in SEQ ID NO:1095) or ECD (SEQ ID NO:1098, e.g. stack set forth in SEQ ID NO:1091) retain binding to CTLA-4 (FIG. 9A), CD28 (FIG. 10A) and PD-L1 (FIG. 11A), compared to molecules containing only individual wild-type or variant IgSF domains. Stack constructs containing mutations Q25L/Q86R/H90L/N104S in IgV (SEQ ID NO:1103, e.g. stack set forth in SEQ ID NO:1096) or ECD (SEQ ID NO:1099, e.g. stack set forth in SEQ ID NO:1092) retain binding to CTLA-4 (FIG. 9B), CD28 (FIG. 10B) and PD-L1 (FIG. 11B), compared to molecules containing only individual wild-type or variant IgSF domains.

B. PD-L1-Dependent CD28 Costimulation

Exemplary variant stack constructs were assessed for their ability to deliver PD-L1 dependent costimulation of CD28 using Jurkat/IL-2 reporter cells expressing PD-1. K562/OKT3/PD-L1 or K562/OKT3 artificial antigen presenting cells (aAPCs) were plated at 20,000 cells/well and pre-incubated with various amounts of exemplary variant stack constructs from 0.01 nM to 100 nM. An Fc only molecule was also tested as control. Jurkat effector cells expressing an IL-2-luciferase reporter were added at a total of 100,000 cells per well, such that each well had a final ratio of 1:5 K562: Jurkat cells. Jurkat cells, K562 cells, and exemplary stack constructs were incubated for 6 hours at 37 degrees Celsius. 100 µL of a cell lysis and luciferase substrate solution (BioGlo luciferase reagent, Promega) were added to each well and luminescence was measured.

Figure 12:
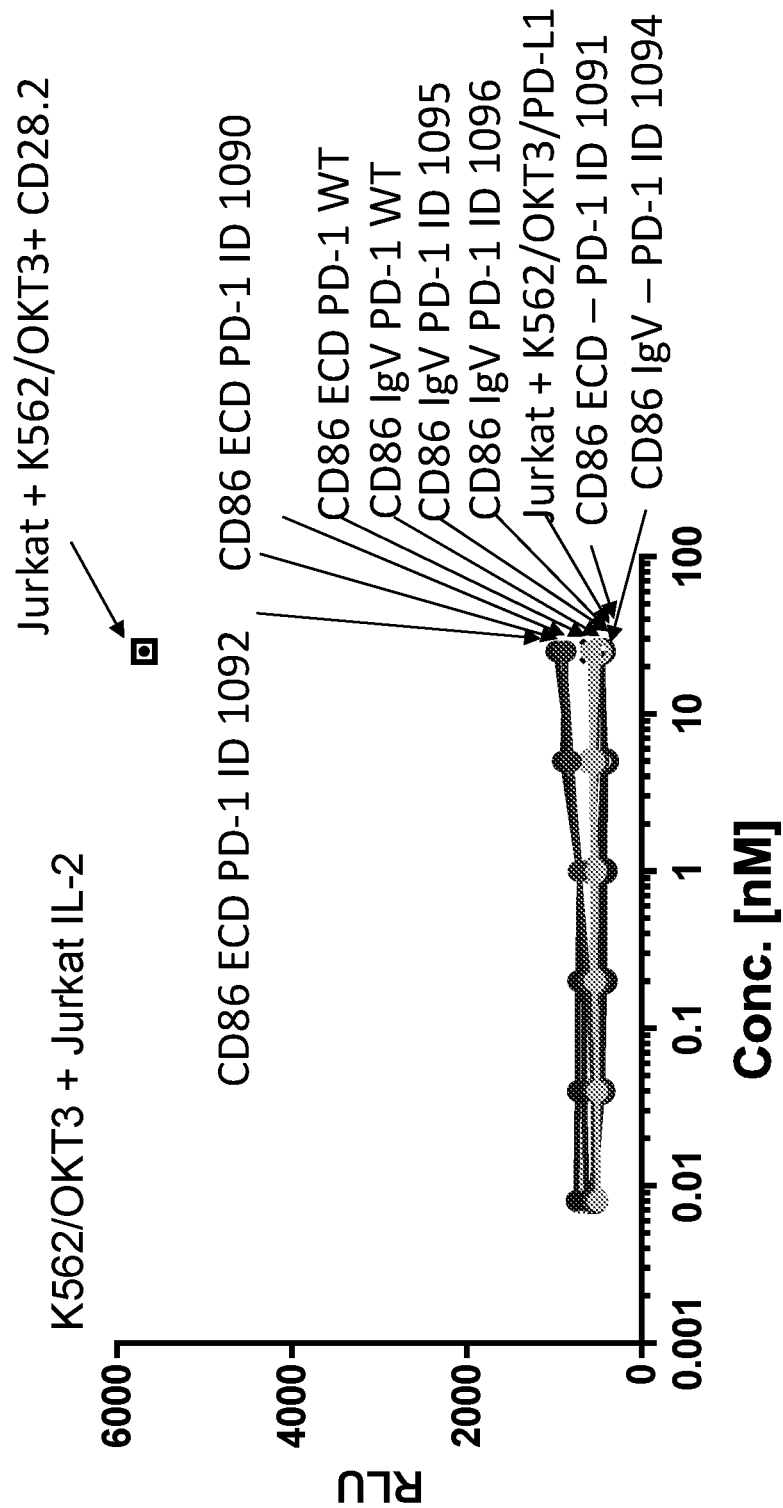
FIG. 12A and FIG. 12B depict the ability of exemplary variant PD1-CD86 stack constructs to deliver PD-L1 dependent costimulation of CD28 using Jurkat/IL-2 reporter cells (FIG. 12A) or Jurkat/IL-2 reporter cells expressing PD-L1 (FIG. 12B), as measured by IL-2 luminiescence relative luminescence units (RLU).
Figure 12:
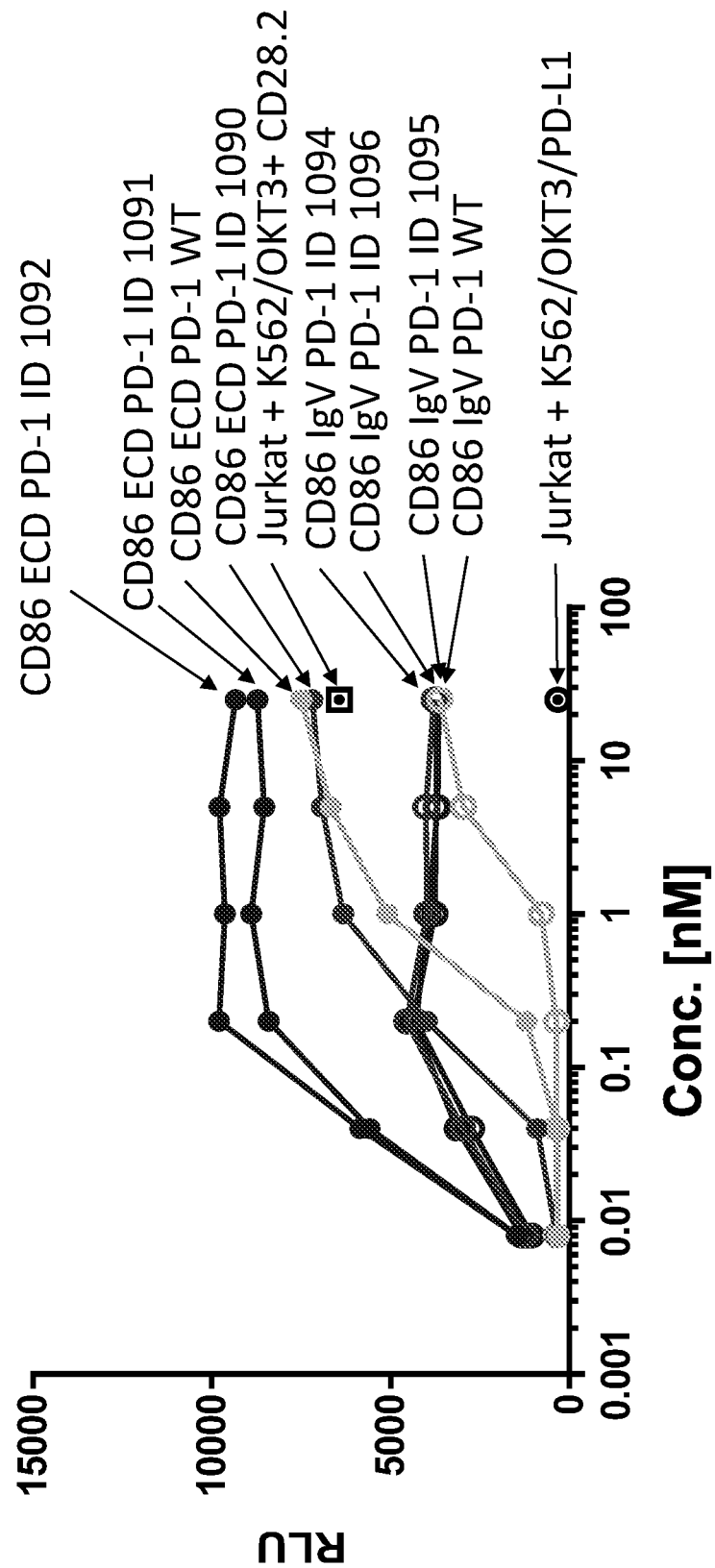

As shown in FIG. 12A, the addition of the exemplary variant stack constructs in the absence of PD-L1 exhibited little to no co-stimulatory signal consistent with the observation that PD-1/CD86 containing stack proteins require PD-L1 binding to induce a costimulatory signal via CD28. As shown in FIG. 12B, the addition of both ECD and IgV exemplary variant stack constructs in the presence of PD-L1 agonized CD28 dependent luminescent activity, as measured by IL-2 luminiescence relative luminescence units (RLU). The level of costimulation correlated with the CD28 and/or PD-L1 binding affinity of the variant molecules. This result is consistent with the activity of the variant PD-1-containing stack immunomodulatory proteins to exhibit PD-L1-dependent CD28-mediated costimulation.

C. T Cell Response

A cytomegalovirus (CMV) antigen-specific functional assay was used to assess the effect of exemplary variant stack molecules on T cell responses.

Peripheral blood mononuclear cells (PBMC) obtained from CMV seropositive donor were thawed and CMV lysate added at 1 µg/mL to 250,000/well PBMC in the presence of tested exemplary variant stack constructs (diluted at 1:3 dilutions from 100,000 pM to 46 pm). An Fc only molecule was also tested as control. Supernatant was collected 48 hours after incubation to assay IL-2 by ELISA, and 96 hours after incubation to assay IFNg by ELISA.

Figure 13:
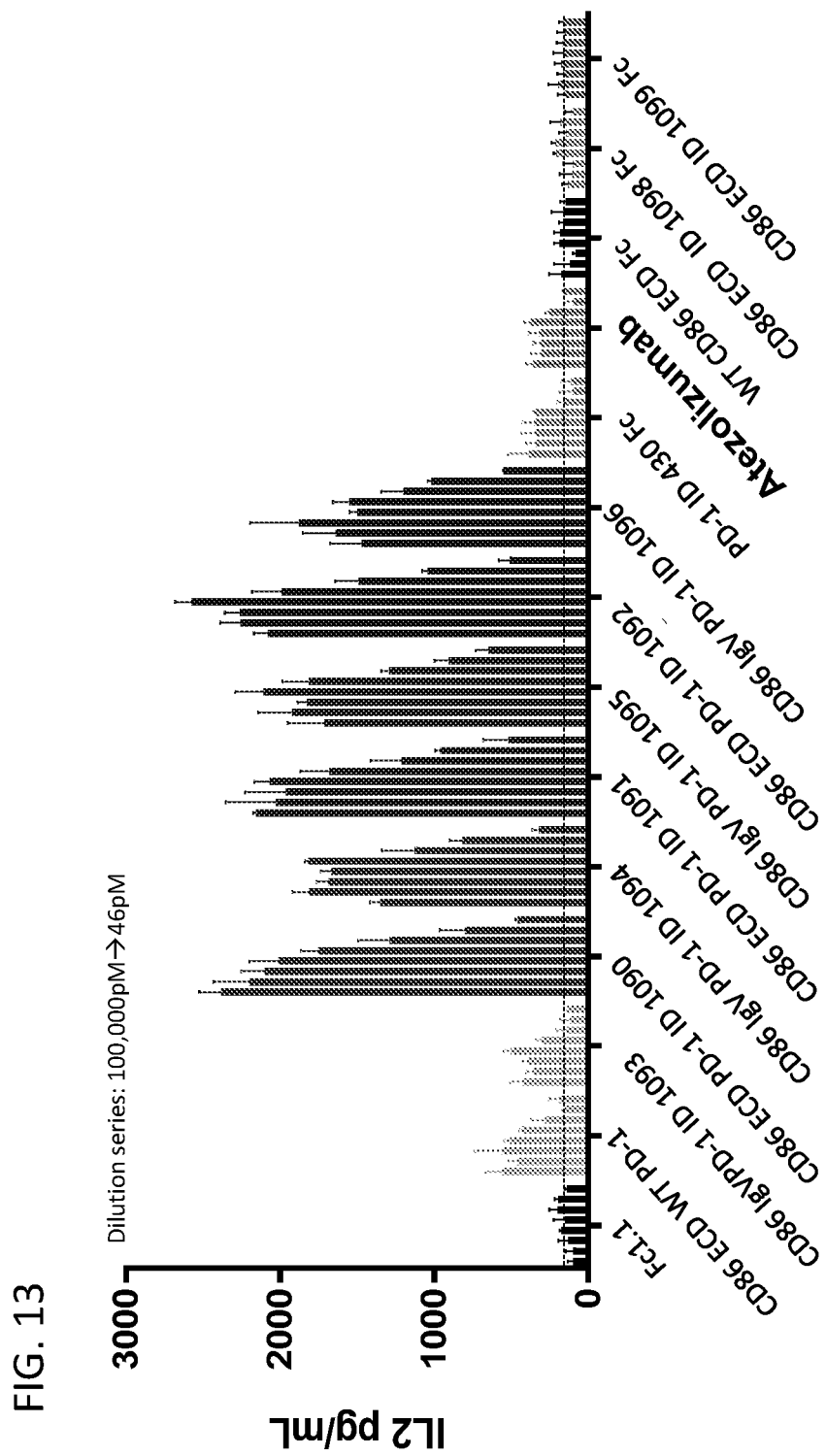
FIG. 13 and FIG. 14 depict cytokine concentrations (pg/mL) from T cell supernatants from a cytomegalovirus (CMV) antigen-specific functional assay. Supernatants were determined for IL-2 (FIG. 13) and IFNg (FIG. 14), as assessed by ELISA.
Figure 14:
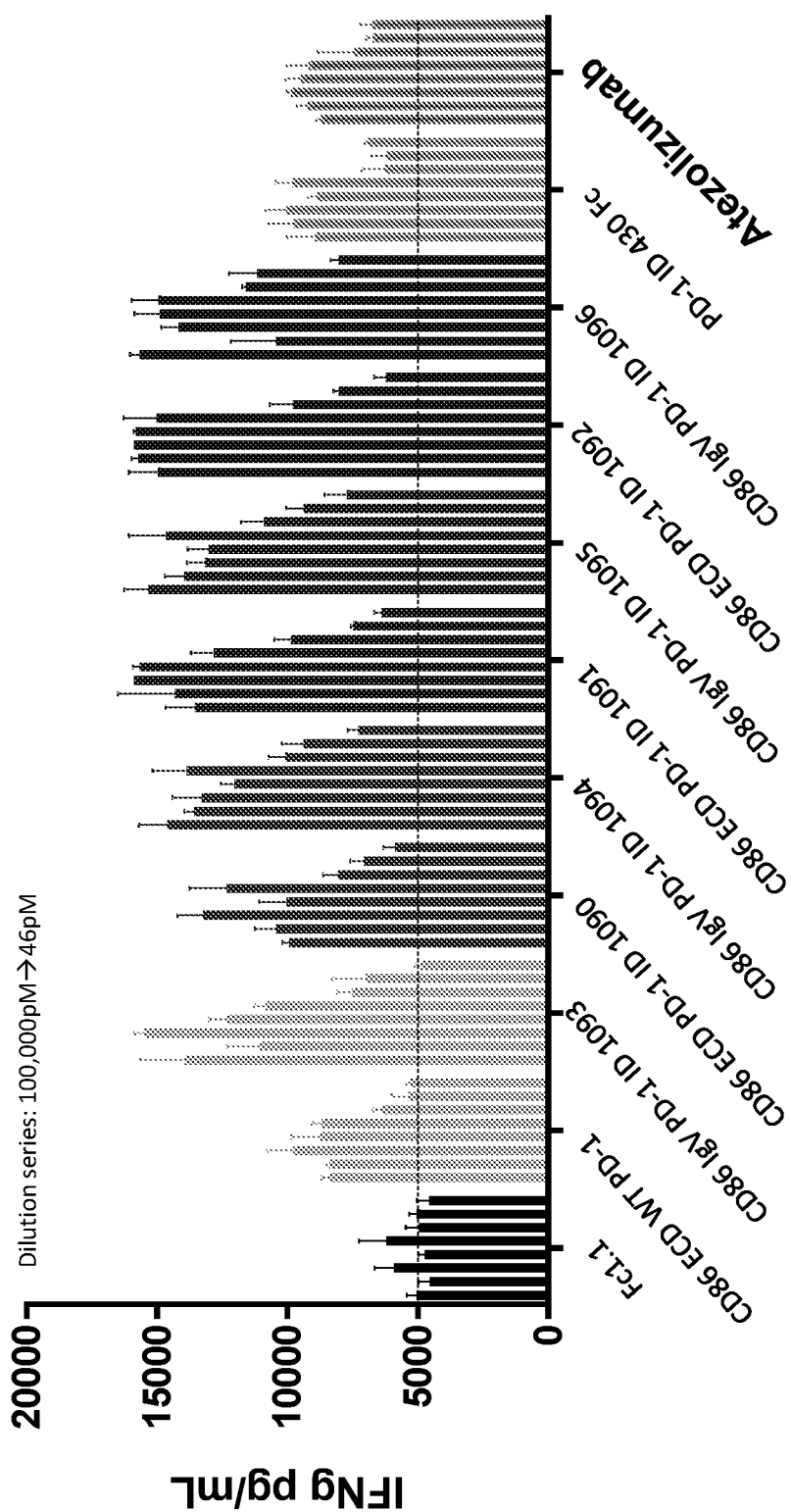

The exemplary PD1-CD86 stack constructs showed a concentration dependent increase in IL-2 production (FIG. 13) and IFNg production (FIG. 14). The PD1-CD86 stack constructs stimulated the production of cytokines to a greater degree than PD-L1 control antibody (atezolizumab) or the individual variant PD1 IgV-Fc molecule. The PD1-CD86 stack constructs also stimulated the production of cytokines to a greater degree than wild-type CD86 ECD-Fc or the individual variant CD86 ECD-Fc molecules.

These results are consistent with PD1-CD86 stack molecules displaying costimulatory effects to stimulate CD28 in a PD-L1-dependent manner. These results were observed for constructs with varying degrees of binding to CD28 on Jurkat cells as shown in Example 18.B above, including stack constructs containing a wild-type CD86 ECD that was observed to have low detectable binding to CD28.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (1104 sequences)

SEQ ID NO: 1 - protein, 288 aa, Homo sapiens
  MISC_FEATURE: CD80(B7-1)
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 2 - protein, 329 aa, Homo sapiens
  MISC_FEATURE: CD86(B7-2)
MDPQCTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 3 - protein, 290 aa, Homo sapiens
  MISC_FEATURE: CD274 (PD-L1, B7-H1)
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 4 - protein, 273 aa, Homo sapiens
  MISC_FEATURE: PDCD1LG2(PD-L2, CD273)
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 5 - protein, 302 aa, Homo sapiens
  MISC_FEATURE: ICOSLG(B7RP1, CD275, ICOSL, B7-H2)
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 6 - protein, 534 aa, Homo sapiens
  MISC_FEATURE: CD276(B7-H3)
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 7 - protein, 282 aa, Homo sapiens
  MISC_FEATURE: VTCN1(B7-H4)
MASLGQILFWSIISIIIILAGAIALIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 8 - protein, 220 aa, Homo sapiens
  MISC_FEATURE: CD28
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 9 - protein, 223 aa, Homo sapiens
  MISC_FEATURE: CTLA4
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 10 - protein, 288 aa, Homo sapiens
  MISC_FEATURE: PDCD1(PD-1)
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 11 - protein, 199 aa, Homo sapiens
  MISC_FEATURE: ICOS
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 12 - protein, 289 aa, Homo sapiens
  MISC_FEATURE: BTLA(CD272)
MKTLPAMLGTGKLFWVFFLIPYLDIWNIHGKESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYRLLPLGGLPLLITTCFCLFCCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 13 - protein, 458 aa, Homo sapiens
  MISC_FEATURE: CD4
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 14 - protein, 235 aa, Homo sapiens
  MISC_FEATURE: CD8A(CD8-alpha)
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 15 - protein, 210 aa, Homo sapiens
  MISC_FEATURE: CD8B(CD8-beta)
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 16 - protein, 525 aa, Homo sapiens
  MISC_FEATURE: LAG3
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 17 - protein, 301 aa, Homo sapiens
  MISC_FEATURE: HAVCR2(TIM-3)
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 18 - protein, 526 aa, Homo sapiens
  MISC_FEATURE: CEACAM1
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 19 - protein, 244 aa, Homo sapiens
  MISC_FEATURE: TIGIT
MRWCLLLIWAQGLRQAPLASGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 20 - protein, 417 aa, Homo sapiens
  MISC_FEATURE: PVR(CD155)
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRNAIIFLVLGILVFLILLGIGIYFYWSKCSREVLWHCHLCPSSTEHASASANGHVSYSAVSRENSSSQDPQTEGTR

SEQ ID NO: 21 - protein, 538 aa, Homo sapiens
  MISC_FEATURE: PVRL2(CD112)
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 22 - protein, 336 aa, Homo sapiens
  MISC_FEATURE: CD226
MDYPTLLLALLHVYRALCEEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 23 - protein, 351 aa, Homo sapiens
  MISC_FEATURE: CD2
MSFPCKFVASFLLIFNVSSKGAVSKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 24 - protein, 180 aa, Homo sapiens
  MISC_FEATURE: CD160
MLLEPGRGCCALAILLAIVDIQSGGCINITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQA

SEQ ID NO: 25 - protein, 278 aa, Homo sapiens
  MISC_FEATURE: CD200
MERLVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDRGELSQGVQKMT

SEQ ID NO: 26 - protein, 325 aa, Homo sapiens [sequence omitted]

SEQ ID NO: 27 - protein, 201 aa, Homo sapiens
  MISC_FEATURE: NC R3 (NKp30)
MAWMLLLILIMVHPGSCALWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKCLTWKGPRRQLPAVVPAPLPPPCGSSAHLLPPVPGG

SEQ ID NO: 28 - protein, 208 aa, Homo sapiens [sequence omitted]

SEQ ID NO: 29 - protein, 224 aa, Homo sapiens
  MISC_FEATURE: CD86(B7-2) ECD
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 30 - protein, 220 aa, Homo sapiens
  MISC_FEATURE: CD274 (PD-L1, B7-H1) ECD
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 31 - protein, 201 aa, Homo sapiens
  MISC_FEATURE: PDCD1LG2(PD-L2, CD273) ECD
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 32 - protein, 238 aa, Homo sapiens [sequence omitted]

SEQ ID NO: 33 - protein, 438 aa, Homo sapiens
  MISC_FEATURE: CD276(B7-H3) ECD
LEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEA

SEQ ID NO: 34 - protein, 235 aa, Homo sapiens
  MISC_FEATURE: VTCN1(B7-H4) ECD
LIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKAS

SEQ ID NO: 35 - protein, 134 aa, Homo sapiens
  MISC_FEATURE: CD28 ECD
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKP

SEQ ID NO: 36 - protein, 126 aa, Homo sapiens [sequence omitted]

SEQ ID NO: 37 - protein, 150 aa, Homo sapiens [sequence omitted]

SEQ ID NO: 38 - protein, 120 aa, Homo sapiens
  MISC_FEATURE: ICOS ECD
EINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLK

SEQ ID NO: 39 - protein, 127 aa, Homo sapiens
  MISC_FEATURE: BTLA(CD272) ECD
KESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYR

SEQ ID NO: 40 - protein, 371 aa, Homo sapiens
  MISC_FEATURE: CD4 ECD
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQP

SEQ ID NO: 41 - protein, 161 aa, Homo sapiens
  MISC_FEATURE: CD8A(CD8-alpha) ECD
SQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACD

SEQ ID NO: 42 - protein, 149 aa, Homo sapiens
  MISC_FEATURE: CD8B(CD8-beta) ECD
LQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSP

SEQ ID NO: 43 - protein, 422 aa, Homo sapiens
  MISC_FEATURE: LAG3 ECD
VPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHL

SEQ ID NO: 44 - protein, 181 aa, Homo sapiens
  MISC_FEATURE: HAVCR2(TIM-3) ECD
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIG

SEQ ID NO: 45 - protein, 394 aa, Homo sapiens
  MISC_FEATURE: CEACAM1 ECD
QLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPG

SEQ ID NO: 46 - protein, 120 aa, Homo sapiens
  MISC_FEATURE: TIGIT ECD
MMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIP

SEQ ID NO: 47 - protein, 323 aa, Homo sapiens
  MISC_FEATURE: PVR(CD155) ECD
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 48 - protein, 329 aa, Homo sapiens
  MISC_FEATURE: PVRL2(CD112) ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 49 - protein, 236 aa, Homo sapiens [sequence omitted]

SEQ ID NO: 50 - protein, 185 aa, Homo sapiens
  MISC_FEATURE: CD2 ECD
KEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLD

SEQ ID NO: 51 - protein, 133 aa, Homo sapiens
  MISC_FEATURE: CD160 ECD
INITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLS

SEQ ID NO: 52 - protein, 202 aa, Homo sapiens
  MISC_FEATURE: CD200 ECD
QVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKG

SEQ ID NO: 53 - protein, 215 aa, Homo sapiens
  MISC_FEATURE: CD200R1(CD200R) ECD
MDEKQITQNYSKVLAEVNTSWPVKMATNAVLCCPPIALRNLIIITWEIILRGQPSCTKAYRKETNETKETNCTDERITWVSRPDQNSDLQIRPVAITHDGYYRCIMVTPDGNFHRGYHLQVLVTPEVTLFQNRNRTAVCKAVAGKPAAQISWIPEGDCATKQEYWSNGTVTVKSTCHWEVHNVSTVTCHVSHLTGNKSLYIELLPVPGAKKSAKL

SEQ ID NO: 54 - protein, 117 aa, Homo sapiens
  MISC_FEATURE: NC R3 (NKp30) ECD
LWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLG

SEQ ID NO: 55 - protein, 254 aa, Homo sapiens
  MISC_FEATURE: Mature CD80(B7-1)
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 56 - protein, 306 aa, Homo sapiens
  MISC_FEATURE: Mature CD86(B7-2)
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 57 - protein, 272 aa, Homo sapiens
  MISC_FEATURE: Mature CD274 (PD-L1, B7-H1)
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 58 - protein, 254 aa, Homo sapiens
  MISC_FEATURE: Mature PDCD1LG2(PD-L2, CD273)
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 59 - protein, 284 aa, Homo sapiens
  MISC_FEATURE: Mature ICOSLG(B7RP1, CD275, ICOSL, B7-H2)
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 60 - protein, 506 aa, Homo sapiens
  MISC_FEATURE: Mature CD276(B7-H3)
LEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 61 - protein, 258 aa, Homo sapiens
  MISC_FEATURE: Mature VTCN1(B7-H4)
LIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 62 - protein, 202 aa, Homo sapiens
  MISC_FEATURE: Mature CD28
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 63 - protein, 188 aa, Homo sapiens
  MISC_FEATURE: Mature CTLA4
KAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 64 - protein, 268 aa, Homo sapiens
  MISC_FEATURE: Mature PDCD1(PD-1)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 65 - protein, 179 aa, Homo sapiens
  MISC_FEATURE: Mature ICOS
EINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 66 - protein, 259 aa, Homo sapiens
  MISC_FEATURE: Mature BTLA(CD272)
KESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYRLLPLGGLPLLITTCFCLFCCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 67 - protein, 433 aa, Homo sapiens
  MISC_FEATURE: Mature CD4
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 68 - protein, 214 aa, Homo sapiens
  MISC_FEATURE: Mature CD8A(CD8-alpha)
SQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 69 - protein, 189 aa, Homo sapiens
  MISC_FEATURE: Mature CD8B(CD8-beta)
LQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 70 - protein, 497 aa, Homo sapiens
  MISC_FEATURE: Mature LAG3
VPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 71 - protein, 280 aa, Homo sapiens
  MISC_FEATURE: Mature HAVCR2(TIM-3)
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 72 - protein, 492 aa, Homo sapiens
  MISC_FEATURE: Mature CEACAM1
QLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 73 - protein, 222 aa, Homo sapiens
  MISC_FEATURE: Mature TIGIT
MTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 74 - protein, 397 aa, Homo sapiens
  MISC_FEATURE: Mature PVR(CD155)
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRNAIIFLVLGILVFLILLGIGIYFYWSKCSREVLWHCHLCPSSTEHASASANGHVSYSAVSRENSSSQDPQTEGTR

SEQ ID NO: 75 - protein, 507 aa, Homo sapiens
  MISC_FEATURE: Mature PVRL2(CD112)
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 76 - protein, 318 aa, Homo sapiens
  MISC_FEATURE: Mature CD226
EEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 77 - protein, 327 aa, Homo sapiens
  MISC_FEATURE: Mature CD2
KEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 78 - protein, 154 aa, Homo sapiens
  MISC_FEATURE: Mature CD160
INITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQA

SEQ ID NO: 79 - protein, 248 aa, Homo sapiens
  MISC_FEATURE: Mature CD200
QVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDRGELSQGVQKMT

SEQ ID NO: 80 - protein, 297 aa, Homo sapiens
  MISC_FEATURE: Mature CD200R1(CD200R)
MDEKQITQNYSKVLAEVNTSWPVKMATNAVLCCPPIALRNLIIITWEIILRGQPSCTKAYRKETNETKETNCTDERITWVSRPDQNSDLQIRPVAITHDGYYRCIMVTPDGNFHRGYHLQVLVTPEVTLFQNRNRTAVCKAVAGKPAAQISWIPEGDCATKQEYWSNGTVTVKSTCHWEVHNVSTVTCHVSHLTGNKSLYIELLPVPGAKKSAKLYIPYIILTIIILTIVGFIWLLKVNGCRKYKLNKTESTPVVEEDEMQPYASYTEKNNPLYDTTNKVKASEALQSEVDTDLHTL

SEQ ID NO: 81 - protein, 183 aa, Homo sapiens
  MISC_FEATURE: Mature NC R3 (NKp30)
LWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKCLTWKGPRRQLPAVVPAPLPPPCGSSAHLLPPVPGG

SEQ ID NO: 82 - protein, 414 aa, Homo sapiens
  MISC_FEATURE: VSIG8
MRVGGAFHLLLVCLSPALLSAVRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIGVIIGIVLGSLLALGCLAVGIWGLVCCCCGGSGAGGARGAFGYGNGGGVGGGACGDLASEIREDAVAPGCKASGRGSRVTHLLGYPTQNVSRSLRRKYAPPPCGGPEDVALAPCTAAAACEAGPSPVYVKVKSAEPADCAEGPVQCKNGLLV

SEQ ID NO: 83 - protein, 393 aa, Homo sapiens
  MISC_FEATURE: Mature VSIG8
VRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIGVIIGIVLGSLLALGCLAVGIWGLVCCCCGGSGAGGARGAFGYGNGGGVGGGACGDLASEIREDAVAPGCKASGRGSRVTHLLGYPTQNVSRSLRRKYAPPPCGGPEDVALAPCTAAAACEAGPSPVYVKVKSAEPADCAEGPVQCKNGLLV

SEQ ID NO: 84 - protein, 242 aa, Homo sapiens
  MISC_FEATURE: VSIG8 ECD
VRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIG

SEQ ID NO: 85 - protein, 18 aa, Artificial Sequence
  HSA signal peptide
MKWVTFISLLFLFSSAYS

SEQ ID NO: 86 - protein, 22 aa, Artificial Sequence
  Ig kappa light chain
MDMRAPAGIFGFLLVLFPGYRS

SEQ ID NO: 87 - protein, 19 aa, Artificial Sequence
  Human azurocidin preprotein signal sequence
MTRLTVLALLAGLLASSRA

SEQ ID NO: 88 - protein, 19 aa, Artificial Sequence
  IgG heavy chain signal peptide
MELGLSWIFLLAILKGVQC

SEQ ID NO: 89 - protein, 19 aa, Artificial Sequence
  IgG heavy chain signal peptide
MELGLRWVFLVAILEGVQC

SEQ ID NO: 90 - protein, 19 aa, Artificial Sequence
  IgG heavy chain signal peptide
MKHLWFFLLLVAAPRWVLS

SEQ ID NO: 91 - protein, 19 aa, Artificial Sequence
  IgG heavy chain signal peptide
MDWTWRILFLVAAATGAHS

SEQ ID NO: 92 - protein, 19 aa, Artificial Sequence
  IgG heavy chain signal peptide
MDWTWRFLFVVAAATGVQS

SEQ ID NO: 93 - protein, 19 aa, Artificial Sequence
  IgG heavy chain signal peptide
MEFGLSWLFLVAILKGVQC

SEQ ID NO: 94 - protein, 19 aa, Artificial Sequence
  IgG heavy chain signal peptide
MEFGLSWVFLVALFRGVQC

SEQ ID NO: 95 - protein, 26 aa, Artificial Sequence
  IgG heavy chain signal peptide
MDLLHKNMKHLWFFLLLVAAPRWVLS

SEQ ID NO: 96 - protein, 22 aa, Artificial Sequence
  IgG Kappa light chain signal sequences
MDMRVPAQLLGLLLLWLSGARC

SEQ ID NO: 97 - protein, 22 aa, Artificial Sequence
  IgG Kappa light chain signal sequences
MKYLLPTAAAGLLLLAAQPAMA

SEQ ID NO: 98 - protein, 17 aa, Artificial Sequence
  Gaussia luciferase
MGVKVLFALICIAVAEA

SEQ ID NO: 99 - protein, 18 aa, Artificial Sequence
  Human albumin
MKWVTFISLLFLFSSAYS

SEQ ID NO: 100 - protein, 18 aa, Artificial Sequence
  Human chymotrypsinogen
MAFLWLLSCWALLGTTFG

SEQ ID NO: 101 - protein, 14 aa, Artificial Sequence
  Human interleukin-2
MQLLSCIALILALV

SEQ ID NO: 102 - protein, 15 aa, Artificial Sequence
  Human trypsinogen-2
MNLLLILTFVAAAVA

SEQ ID NO: 103 - protein, 150 aa, Artificial Sequence
  PD-1 v1 (1-150)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKVQIKESLLVELRVTERRAEVPTAHPSPSPRPAGQFQTLV

SEQ ID NO: 104 - protein, 150 aa, Artificial Sequence
  PD-1 v2 (1-150)
PGWFLDSPDRPWSPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRVELRVTERRAEVPTAHPSPSPRAAGQFQTLV

SEQ ID NO: 105 - protein, 150 aa, Artificial Sequence
  PD-1 v3 (1-150)
PGWFLDSPDRPWNPPTFSPALLVVTEGDNATFTYSFSNTSESFVLNWYRMSPSDQTDKLAAFPEDRSQPGQDCRFRVTQLPNGRDFHMSVVRARRNDSGSYLCGAISLAPKVQIKESLRVELRVTERRAEVPTAHPSPSPRPAGQFQTLV

SEQ ID NO: 106 - protein, 150 aa, Artificial Sequence
  PD-1 v4 (1-150)
PGWFLDSPDRPWNPPTFSPALLVVTEGDNATFTCSFSNTSESFVLNWYRVSPSNQTDKLAAFPEDRNQPGQDCRFRVTQQPNGRDFHMSVVRARRNDSGTYLCGAISLAPKAQIKESLRVELRVTERRAEVPTAHPSPSPRPSGQFQTLV

SEQ ID NO: 107 - protein, 150 aa, Artificial Sequence
  PD-1 v5 (1-150)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKVQIKESLWAELRVTERRAEVPTAHPSPSPRPAGQFQTLV

SEQ ID NO: 108 - protein, 150 aa, Artificial Sequence
  PD-1 v6 (1-150)
PGWFLDSPDRPWNPPTFSPALLVVTEGDNATFTCSFSNTSESFVLNWYRMSPSNQTDKLAAFPEDRSQPGQDCRFRVTQLPNGHDFLMSVVRARRNDSGTYLCGAISLAPKVQIKESLWAELRVTERRAEVPTAHPSPSPRPAGQFQTLV

SEQ ID NO: 109 - protein, 150 aa, Artificial Sequence
  PD-1 v7 (1-150)
PGWFLDSPDRPWNPPTFSPALLVVTEGDNATFTCSFSNTSESFVLNWYRMSPSNQTDKLAAFPEDRSQPGRDCRFRVTQLPNGRDFHMSVIRARRNDSGTYLCGAISLAPKVQIKESLLVELRVSERRAEVPTAHPSPSPRPAGQFQTLV

SEQ ID NO: 110 - protein, 150 aa, Artificial Sequence
  PD-1 v8 (1-150)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKVQIEESLRAELRVTERRAEVPTAHPSPSPRPAGQFQTLV

SEQ ID NO: 111 - protein, 150 aa, Artificial Sequence
  PD-1 v9 (1-150)
PGWFLDSPDRPWNPPTFSPALLVVTEGDNATFTCSFSNTSESFVLNWYRLSPSNQTDKVAAFPEDHSQPGQDCRFRVTQLPNGRDFHMSVVRARRNDSGTYLCGAISLAPKVQIKESLRAELRVTERRAEVPTAYPSTSPRLAGQFQTLV

SEQ ID NO: 112 - protein, 150 aa, Artificial Sequence
  PD-1 v10 (1-150)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLWAELRVTERRAEVPTAHPSPSPRPAGQFQTLV

SEQ ID NO: 113 - protein, 150 aa, Artificial Sequence
  PD-1 v11 (1-150)
PGWFLDSPDRPWNPPTFSPALLVVTEGDNATFTCSFSNTSESFVLNWYRMSPGNRTDKLAAFPEDRSQPGQDCRFRVTQLPNGRDFHMSVVRARRNDSGTYLCGAISLAPKVQIEESLRVELRVTERRAEVPTAHPSPTPRPAGQFQTLV

SEQ ID NO: 114 - protein, 150 aa, Artificial Sequence
  PD-1 v12 (1-150)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLWAELRVTERRAEVPTARPSPSPRPAGQFQTLV

SEQ ID NO: 115 - protein, 150 aa, Artificial Sequence
  PD-1 v13 (1-150)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRVELRVIERRAEVPTAHPSPSPRPAGQFQTLV

SEQ ID NO: 116 - protein, 150 aa, Artificial Sequence
  PD-1 v14 (1-150)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKVQIKESLRVELRVTERRAEAPTAHPSPSPRPAGQFQTLV

SEQ ID NO: 117 - protein, 150 aa, Artificial Sequence
  PD-1 v15 (1-150)
PGWFLDSPDRPWNPPTISPALLVVTEGDNATFTCSFSNTSESFVLNWYRMSPSNQTDKLAAFPEDRSQPGQDCRFRVTQLPNGRDFHMSVVRARRNDSGTYLCGAISLAPEVQIKESLRVELRVTERRAEVPTAHPSPSPRPAGQFQTLV

SEQ ID NO: 118 - protein, 150 aa, Artificial Sequence
  PD-1 v16 (1-150)
PGWFLDSPDRPWNPPTFTPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLQAELRVTERRAEVPTAHPSPSPMPAGQFQTLV

SEQ ID NO: 119 - protein, 150 aa, Artificial Sequence
  PD-1 v17 (1-150)
PGWFLDSPDRPWNPPTFSPALLVVTEGDNATFTCSLTNTSESFVLNWYRMSPSNQTDKLAAFPEDRSQPGQDCRFRVTQLPNGRDFHMSVVRARRNDSGTYLCGAISLAPKVQIKESLRAELRVTERRAEVPTANPSSSPRPAGQFQTLV

SEQ ID NO: 120 - protein, 150 aa, Artificial Sequence
  PD-1 v18 (1-150)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKVQIKESLRAELRVIERRAEVPTAHPSPSPRPAGQFQTLV

SEQ ID NO: 121 - protein, 150 aa, Artificial Sequence
  PD-1 v19 (1-150)
PGWFLDSPDRPWNPPTFSPALLVVTEGDNATFTCSFSNTSESFVLNWYRISPSNQTDKLAAFPEDRSQPGQDCRFRVTQLPNGRDFHMSVVRARRNDSGTYLCGAISLAPKVQIKESLRVELRVTERRAEVPTAHPSPSPRPAGQFQTLV

SEQ ID NO: 122 - protein, 150 aa, Artificial Sequence
  PD-1 v20 (1-150)
PGWFLDSPDRPWNPPTFSPALLVVTEGDNATFTCSFSNTSESFVLNWYRMSPSNQTDKLAAFPEDRNQPGQDRRFRVTQLPNGRDFHMSVVRVRRNDSGTYLCGAISLAPKVQIKESLRVELRVTERRAEVPTAHPSPSPRPAGQFQTLV

SEQ ID NO: 123 - protein, 150 aa, Artificial Sequence
  PD-1 v21 (1-150)
PGWFLDSPDRPWNPPTFSPALLVVTEGDNATFTCSFSNTSESFVLNWYRMSPSNQTDKLAAFPEDRSQPGQGCRFRVTQLPNGRDFHMSVVRARRNDSGTYLCGAISLAPKVQIKESLRVELRVTERRAEVPTAHPSPSPRPAGQFQTLV

SEQ ID NO: 124 - protein, 150 aa, Artificial Sequence
  PD-1 v22 (1-150)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRDDSGTYLCGAISLAPKVQIKESLRVELRVSERRAEVPTAHPSPSPRPAGQFQTLV

SEQ ID NO: 125 - protein, 150 aa, Artificial Sequence
  PD-1 v23 (1-150)
PGWFLDSPDRPWNPPTFSPALLVVTEGDNATFTCSFSNTSESFVLNWYRMSPSNQTDKLAAFPEDRSQPGQDCRFRVTQLPNGRDYHMSVVRARRNDSGTYLCGAISLAPKAQIKESLWAELRVIERRAEVPTAHPSPSPRPAGQFQTLV

SEQ ID NO: 126 - protein, 150 aa, Artificial Sequence
  PD-1 v24 (1-150)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLPAELRVTERRAEVPRAHPSPSPRPAGQFQTLV

SEQ ID NO: 127 - protein, 150 aa, Artificial Sequence
  PD-1 v25 (1-150)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPMVQIEESLRAELRVTERRAEVHTAHPSPSPRPAGQFQTLV

SEQ ID NO: 128 - protein, 150 aa, Artificial Sequence
  PD-1 v26 (1-150)
PGWFLDSPDRPWNPPTFSPALLVVTEGDNATFTCSFSNTSESFVLNWYRMSPSNQTDKLAAFPEDRGQPGQDCRFRVTQLPNGRDFHMSVVRARRNDSGTYLCGAISLAPKVQIKESLRAELRVIERRAEVPSAHPSPSPRPAGQFQTLV

SEQ ID NO: 129 - protein, 150 aa, Artificial Sequence
  PD-1 v27 (1-150)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKVQIKESLRVELRVTERRAEVPTAHPSPSPRPAGQFQTLV

SEQ ID NO: 130 - protein, 150 aa, Artificial Sequence
  PD-1 v28 (1-150)
PGWFLDSPDRPWNPPTFSPALLVVTEGDNATFTCSFPNTSESFVLNWYRMSPSNQTDKLAAFPEDRSQPGQDCRFRVTQLPNGRDFHMSVVRARRNDSGTYLCGAISLAPKVQIKESLWAELRVTERRAEVPTAHPSPSPRPAGQFQTLV

SEQ ID NO: 131 - protein, 150 aa, Artificial Sequence
  PD-1 v29 (1-150)
PGWFLDSPDRPLNPPTFSPALLVVTEGDNATFTCSFPNTSESFVLNWYRMSPSNQTDKLAAFPEDRSQPGQDCRFRVTQLPNGRDFHMSVVRARRNDSGTYLCGAISLAPKVQIKESLWAELRVTERRAEVPTAHPSPSPRPAGQFQTLV

SEQ ID NO: 132 - protein, 150 aa, Artificial Sequence
  PD-1 v30 (1-150)
PGWFLDSPGRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKVQIKESLRVELRVTERRAEVPTAHPSPSPRPAGQFQTLV

SEQ ID NO: 133 - protein, 150 aa, Artificial Sequence
  PD-1 v31 (1-150)
PGWFLDSPDRPWNPPTFSPALLVVTEGDNASFTCSFTNTSESFVLNWYRMSPSNQTDKLAAFPEDRSQPGQDCRFRVTQLPNGRDFHMSVVRARRNDSGTYLCGAISLAPKVQIKESLRAELRVIERRAEVPTAHPSPSPRPSGQFQTLV

SEQ ID NO: 134 - protein, 150 aa, Artificial Sequence
  PD-1 v32 (1-150)
PGWFLDSPDRPWNPPTFSPALLVVTEGDNATFTCSFTNTSESFVLNWYRMSPSNQTDKLAAFPEDRSQPGQDCRFRVTQLPNGRDFHMSVVRARRNDSGTYLCGAISLAPKVQIKESLRAELRVIERRAEVPTAHPSPSPRPAGQFQTLV

SEQ ID NO: 135 - protein, 150 aa, Artificial Sequence
  PD-1 v33 (1-150)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVGARRNDSGTYLCGAISLAPKVQIKESLRVELRVTERRAEVPTAHPSPSPRPAGQFQTLV

SEQ ID NO: 136 - protein, 150 aa, Artificial Sequence
  PD-1 v34 (1-150)
PGWFLDSPDRPWNPPTFSPALLVVTEGDNATFTCSFSNTSESFVLNWYRMSPSNQTDKLAAFPDDRSQPGQDCRFRVTQLPNGRDYHMSVVRARRNDSGTYLCGAISLAPKVQIKESLRVELRVTERRAEVPTAHPSPSPRPAGQFQTLV

SEQ ID NO: 137 - protein, 150 aa, Artificial Sequence
  PD-1 v35 (1-150)
PGWFLDSPDRPWNPPTFSPALLVVTEGDNATFTCSFSNTSESFVLNWYRMSPSNQTDKLAAFPEDRSQPGQDCRFRVTQLPNGRDFRMSVVRARRNDSGTYLCGAISLAPKVQIKESLWAELRVTERRAEVPTAHPSPSPRPAGQFQTLV

SEQ ID NO: 138 - protein, 150 aa, Artificial Sequence
  PD-1 v36 (1-150)
PGWFLDSPDRPWDPPTFSPALLVVTEGDNATFTCSFSNTSESFVLNWYRMSPSNQTDKLAAFPEDRSQPGQDCRFRVTQLPNGRDFHMSVVRARRNDSGTYLCGVISLAPKVQIKESLRVELRVTERRAEVPTDHPSPSPRPAGQFQTLV

SEQ ID NO: 139 - protein, 150 aa, Artificial Sequence
  PD-1 v37 (1-150)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKVQIKESLLVELRVTERRAEVPTAHPCPSPRPAGQFQTLV

SEQ ID NO: 140 - protein, 150 aa, Artificial Sequence
  PD-1 v38 (1-150)
PGWFLDSPDRPWNPPIFSPALLVVTEGDNATFTCSFSNTSESFVLNWYRISPSNQTDKLAAFPEDRSQPGQDCRFRVTQLPNGRDFHMSVVRARRNDSGTYLCGAISLAPKVQIKESLRVELRVTERRAEVPTAHPSPSPRPAGQFQTLV

SEQ ID NO: 141 - protein, 150 aa, Artificial Sequence
  PD-1 v39 (1-150)
PGWFLDSPDRPWNPPTFSPALLVVTEGDNATFTCSFSNTSESFVLNWYRLSPSNQTDKLAAFPEDRSQPGQDCRFRVTQLPNGRDFHMSVVRARRNDSGTYLCGAISLAPKVQIKESLQVELRVIERRAEVPTARPSPSPRPAGQFQTLV

SEQ ID NO: 142 - protein, 150 aa, Artificial Sequence
  PD-1 v40 (1-150)
PGWFLDSPDRPWNPPTFSPALLVVTEGDNATFTCSFSNTSESFVLNWYRMSPSNQTVKLAAFPEDRSQPGQDCRFRVTQLPNGRDFHMSVVRARRNDSGTYLCGAISLAPKVQIKESLRAELRVTERRAEVPTAHPSPSPRPAGQFQTLV

SEQ ID NO: 143 - protein, 150 aa, Artificial Sequence
  PD-1 v41 (1-150)
PGWFLDSPDRPWNPPTFSPALLVVTEGDNATFTCSFSNTSESFVLNWYRMSPSNQTDKLAAFPEDRNQPGQDCRFRVTQLPNGRDFHMSVVRARRNDSGTYLCGAISLAPKAQIKESLWAELRVTERRAEVPTAHPSPSPRPAGQFQTLV

SEQ ID NO: 144 - protein, 150 aa, Artificial Sequence
  PD-1 v42 (1-150)
PGWFLDSPDRPWNPPTFSPALLVVTEGDNATFTCSFSNTSESFVLNWYRMSPSNQTDKLAAFPEDRNQPGQDCRFRVTQLPNGRDFHMSVVRARRNDSGTYLCGAISLAPKVQIKESLRVELRVTERRAEVPTAHPSPSPRPAGQFQTLV

SEQ ID NO: 145 - protein, 150 aa, Artificial Sequence
  PD-1 v43 (1-150)
PGWFLDSPDRPWNPPTFSPALLVVTEGDNATFTCSFSNTSESFVLNWYRMSPSYQTDKLAAFPEDRSQPGQDCRFRVTQLPNGRDFHMSVVRARRNDSGTYLCGAISLAPKVQIKESLRAELRVTERRAEVPTAHPSPSARPAGQFQTLV

SEQ ID NO: 146 - protein, 150 aa, Artificial Sequence
  PD-1 v44 (1-150)
PGWFLDSPDRPWNPPTFSPALLVVTEGDNATFTCSFSNTSESYVLNWYRMSPSNQTDKLAAFPEDRSQLGQDCRFRVTQLPNGRDFHMSVVRARRNDSGTYLCGAISLAPKAQIKESLWAELRVTERRAEVPTAHPSPSPRPAGQFQTLV

SEQ ID NO: 147 - protein, 150 aa, Artificial Sequence
  PD-1 v45 (1-150)
PGWFLDSPDRPWNPPTFSPALLVVTEGDNATFTCSFSNTSESFVLNWYRMSPSYQTDKLAAFPEDRSQPGQDCRFRVTQLPNGRDFHMSVVRARRNDSGTYLCGAISLAPKVQIKESLWAELRVTERRAEVPTAHPSPSPRPAGQFQTLV

SEQ ID NO: 148 - protein, 150 aa, Artificial Sequence
  PD-1 v46 (1-150)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRVELRVTERRAEVPTAHPSPSPRPAGQFQTLV

SEQ ID NO: 149 - protein, 150 aa, Artificial Sequence
  PD-1 v47 (1-150)
PGWFLDSPDRPWNPPTFSPALLVVTEGDNATFTCSFSNTSESFVLNWYRMSPSNQMDKLAAFPEDRSQPGQDSRFHVTQLPNGRDFHMSVVRARRNDSGTYLCGAISLAPKVQIKESLLVELRVTERRAEVTTAHPSPSPWPAGQFQTLV

SEQ ID NO: 150 - protein, 150 aa, Artificial Sequence
  PD-1 v48 (1-150)
PGWFLDSPDRPWNPPTISPALLVVTEGDNATFTCSFSNTPDSFVLNWYRMSPSNQTDKLAAFPEDRNQPGQDCRFRVTQLPNGRDFHMSVVRARLNDSGTYLCGAISLAPKVQIKESLRVELRVIERRAEVPTAHPSPSPMPAGQFQTLV

SEQ ID NO: 151 - protein, 150 aa, Artificial Sequence
  PD-1 v49 (1-150)
PGWFLDSPDRPWNPPTLSPALLVVTEGDNASFTCNFSNTSESFVLNWYRMSPSNQTDKLAAFPEDRSQPGQDCRFRVTQLSNGRDFHMSVVRARRSDSGTYLCGAISLAPKVQIKESLWAELRVTERRAEVPTAHPSPSPRPAGQFQTLV

SEQ ID NO: 152 - protein, 150 aa, Artificial Sequence
  PD-1 v50 (1-150)
PGWFLDSPDRPWNPPTFSPALLVVTEGDNATFTCSFSNTSESLVLNWYRMSPSNQTDKLAAFPEDRNQPGQDRRFRVTQLPNGRDFHMSVVRARRNDSGTYLCGAISLAPKVQIKESLRVELRVTERRAEVPTAHPSPSPRPAGQFQTLV

SEQ ID NO: 153 - protein, 150 aa, Artificial Sequence
  PD-1 v51 (1-150)
PGWFLDSPDRPLNPPTFSPALLVVTEGDNATFTCSFSDTSESFVLNWYRMSPSNQTDKLAAFPEDRSQPGQDCRFRVTQLPNGRDFHMSVVRARRNDSGTYLCGAISLAPKVQIKESLQVELRVTERRAEVPTAHPSPSPRTAGQFQTLV

SEQ ID NO: 154 - protein, 150 aa, Artificial Sequence
  PD-1 v52 (1-150)
PGWFLDSPDRPWNPPTFSPALLVVTEGDNATFTCSFSNTSESFVLNWYRMSPSNQTDKLAAFPEDRNQHGQDRRFRVTPLPNGRDFHMSVDRARRNDSGTYLCGAISLAPKVQIKESLRVELRVTERRAEVPTAHTSPSPRPDGQFQTLV

SEQ ID NO: 155 - protein, 150 aa, Artificial Sequence
  PD-1 v53 (1-150)
PGWFLDSPDRPWNPPTISPALLVVTEGDNATFTCSFSNTPESFVLNWYRMSPSNQTDKLAAFPEDRNQPGQDCRFRVTRLPNGRDFHMSVVRARRNDSGTYLCGAISLAPKVQIKESLWAELRVIERRAEVPTAHPSPSPRPAGQFQTLV

SEQ ID NO: 156 - protein, 150 aa, Artificial Sequence
  PD-1 v54 (1-150)
PGWFLDSPDRPWNPPTFSPALLVVTEGDNATFTCSFSNTSESYVLNWYRVSPSNQTDKLAAFPEDRNQPGQDRRFRVTQLPNGRDFHMSVVGARRNDSGTYLCGAISLAPKVQIKESLRVELRVTERRAEVPTAHTSPSPRPAGQFQTLV

SEQ ID NO: 157 - protein, 150 aa, Artificial Sequence
  PD-1 v55 (1-150)
PGWFLDSPDRPWNPPTLSPALLVVTEGDNATFTCSFSNTSESFVLNWYRMSPSNQMDKLAAFPEDRNQPGQDCRFRVTQLPNGRDFHMSVVRARRNDSGTYLCGAISLAPKVQIKESLWVELRVTERRAEVPTAHPSPSPRRAGQFQTLV

SEQ ID NO: 158 - protein, 150 aa, Artificial Sequence
  PD-1 v56 (1-150)
PGWFLDSPDRPLNPPTFSPALLVVTEGDNATFTCSFSNTSESFVLNWYRMSPSYQTDKLAAFPEDRNQPGQDCRYRVTQLPNGRDFHMSVDRARLNDSGTYLCAAISLAPKVQIKESLWAELRVTERRAEVPTAHPSPSPMPAGQFQTLV

SEQ ID NO: 159 - protein, 150 aa, Artificial Sequence
  PD-1 v57 (1-150)
PGWFLDSPDRPWNPPTLSPALLVVTEGDNATFTCSFTNTSESFVLNWYRMSPSNQTDKLAAFPEDRNQPGQDCRFRVSQLPNGRDYHMSVVRARRNDSGTYLCGAISLAPKVQIKESLHVELRVTERRAEEPTAHPSPSPRPVGQFQTLV

SEQ ID NO: 160 - protein, 150 aa, Artificial Sequence
  PD-1 v58 (1-150)
PGWFLDSPDRPWDPPTFSPALLVVTEGDNATFTCSFSNTPESFVLNWYRMSPSNQTDKLAAFPEDRSQPGQDCRFRVTQLPNGRDFHMSVVRARRNDSGTYLCGAISLAPKVQIKESLLVELRVTERRAEVPTAHPCPSPRPAGQFQTLV

SEQ ID NO: 161 - protein, 150 aa, Artificial Sequence
  PD-1 v59 (1-150)
PGWFLDSPDRPWNPPTVSPALLVVTEGDNVTFTCSFSNTSVSFVLNWYRMSPSNQTDKLAAFPEDRSQPGQDCRFSVTQLPNGRDFHMSVVRARRNDSGTYLCGAISLAPKVQIKESLQVELRVTERRAEAPTAHPSPSPRPAGQFQTLV

SEQ ID NO: 162 - protein, 150 aa, Artificial Sequence
  PD-1 v60 (1-150)
PGWFLDSPDRPWNPPTISPALLVVAEGDNATFTCSFSNTSESFVLNWYRVSPTNQTDKLAAFPEDSRQPGQDCRFRVTQLPNGRDFHMSVVRARRNDSGTYLCGAITLAPKVQIKESLWAELRVTERRAEVPTAHPSPSPRPVGQFQTLV

SEQ ID NO: 163 - protein, 150 aa, Artificial Sequence
  PD-1 v61 (1-150)
PGWFLDSPDRPWDPPTFSPALLVVTEGDNATFTCSFSNTPESFVLNWYRMSPSNQTDKLAAFPEDRNQPGQDRRFRVTQLPNGRDFHMSVVRARLNDSGTYLCAAISLAPKVQIKESLRVELRVTERRAEVPTAHPSPSPRPAGQFQTLV

SEQ ID NO: 164 - protein, 150 aa, Artificial Sequence
  PD-1 v62 (1-150)
PGWFLDSPDRPWNPPTFSPALLVVTEGDNATFTCSFSNTPESFVLNWYRMSPSNQADKLAAFPEDRNQPGQDRRFRVTQLPNGRDFHMSVVRARRNDSGTYLCGAISLAPKVQIKESLQVELRVTERRAEAPTAHPSPSPRPAGQFQTLV

SEQ ID NO: 165 - protein, 150 aa, Artificial Sequence
  PD-1 v63 (1-150)
PGWFLDSPDRPWYPPTFSPALLVVTEGDNATFTCSFSNTPESLVLNWYRMSPSNQTDKLAAFPEDRSPPGQDCRFRVTQLPNGRDFHMSVVGARRNDSGTYLCGAISLAPKVQIKESLLVELRVTERRAEVPTAHPSPSPRPAGQFQTLV

SEQ ID NO: 166 - protein, 150 aa, Artificial Sequence
  PD-1 v64 (1-150)
PGWFLDSPDRPWNPPTLSPALLVVTEGDNATFTCSFSNTSESFVLNWYRMSPSNQTDKLAAFPEDRNQPGLDSRFRVTQLPNGRDFHMSVVRARRNDSGTYLCGAISLAPKVQIKESLQVELRVTERRAEVPTAHPSPSPRLAGQFQTLV

SEQ ID NO: 167 - protein, 150 aa, Artificial Sequence
  PD-1 v65 (1-150)
PGWFLDSPDRPWNPPTISPALLVVTEGDNATFTCSFSNTPESFVLNWYRMSPSNQTDKLAAFPEDRSQSGQDSRFRVTQLPNGRDFHMSVVRARRSDSGTYLCAAISLAPKVQIKESLRVELRVTERRAEVPTAHPSPSPRPAGQFQTLV

SEQ ID NO: 168 - protein, 150 aa, Artificial Sequence
  PD-1 v66 (1-150)
PGWFLDSPDRPWNPPTISPALLVVTEGDNATFTCSFSNTPESFVLNWYRMSPSNQTDKLAAFPEDRSQPGQDCRFRVTQLPNGRDFHMSVVRARRNDSGTYLCGAISLAPKVQIKESLLVELRVTERRAEVPTAHPSPSRRPAGQFQTLV

SEQ ID NO: 169 - protein, 150 aa, Artificial Sequence
  PD-1 v67 (1-150)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKVQIKESLRVELRVTERRAEVPSAHPSPSPRPAGQFQTLV

SEQ ID NO: 170 - protein, 150 aa, Artificial Sequence
  PD-1 v68 (1-150)
PGWFLDSPDRPWNPPTFSPSLLVVTEGDNATFTCSFSNTSESFVLNWYRMSPSNQTDKLAAFPEDRNQPGQDRRFRVTQLPNGRDFHMSVVRAQRNDSGTYLCGAISLAPKVQIKESLQVELRVIERRAEVSTAHPSPSPRPAGQFQTLV

SEQ ID NO: 171 - protein, 150 aa, Artificial Sequence
  PD-1 v69 (1-150)
PGWFLDSPDRPWDPPTFSPALLVVTEGDNATFTCSFSNTSESFVLNWYRMSPSNQTDKLAAFPEDRNQPGQDRRFRVTQLPNGRDFHMSVVRARLNDSGTYLCGAISLAPKVQIKESLQVELRVIERRAEVPTAHPSPSPRPAGQFQTLV

SEQ ID NO: 172 - protein, 150 aa, Artificial Sequence
  PD-1 v70 (1-150)
PGWFLDSPDRPWNPPTFSPALLVVTEGDNATFTCSFSNTPESFVLNWYRMSPSNQTDKLAAFPEDRNQPGQDRRFRVTQLPNGRDFHMSVVRARRTDSGTYLCGAISLAPKVQIKESLRVELRVTERRAEVPTAHPSPSPRPAGQFQTLV

SEQ ID NO: 173 - protein, 150 aa, Artificial Sequence
  PD-1 v71 (1-150)
PGWFLDSPDRPWNPPTFSPAVLVVTEGDNATFTCSFSNTPESFVLNWYRMSPSNQTDKLAAFPEDRSQPGQDCRFRVTQLPNGRDFHMSVVRARLNDSGTYLCAAISLAPKVQIKESLRVELRVTERRSEAPTAHPSPSPGPAGQFQTLV

SEQ ID NO: 174 - protein, 150 aa, Artificial Sequence
  PD-1 v72 (1-150)
PGWFLDSPDRPWNSPTFSPALLVVTEGDNATFTCSFSNTPERFVLNWYRMSASNQMDKLAAFPEDRSQPGQDCRFRVTQLPNGRDFHMSVVRARRNDSGTYLCGAISLAPKVQIKESLWAELRVIERRAEVPTAHPSPSPRAAGQFQTLV

SEQ ID NO: 175 - protein, 150 aa, Artificial Sequence
  PD-1 v73 (1-150)
PGWFLDSPDRPWNPPTFSPALLVVTEGDNATFTCSFSNTPESLVLNWYRMSPSNQADKLAAFPEDRNQPGQDSRFRVTQLPNGRDFHMSVVRARRNDSGTYLCGAISLAPKVQIKESLLVELRVTERRAEVPTAHPSPSPRPAGQFQTLV

SEQ ID NO: 176 - protein, 150 aa, Artificial Sequence
  PD-1 v74 (1-150)
PGWFLDSPDRPWNPPTISPALLVVTEGDNATFTCSFSNTPESFVLNWYRVSPSNQTDKLAAFPEDRNQPGQDSRFRVTQLPNGRDFHMSVVRARLNDSGTYLCAAISLAPKVQIKESLLVELRVTERRAEVPTAHPSPSPRPAGQFQTLV

SEQ ID NO: 177 - protein, 150 aa, Artificial Sequence
  PD-1 v75 (1-150)
PGWFLDSPDRPWNPPTFSPALLVVTEGDNATFTCSFSNTPESFVLNWYRMSPSNQMDKLAAFPEDRSQPGQDSRFRVTQLPNGRDFHMSVVRARLNDSGTYLCGAISLAPKVQIKESLWAELRVIERRAEAPTAHPSPSPWPAGQFQTLV

SEQ ID NO: 178 - protein, 150 aa, Artificial Sequence
  PD-1 v76 (1-150)
PGWFLDSPDRPWNPPTISPVLLVVTEGDNATFTCSFSNTSESFVLNWYRMGPSDQTDKLAAFPEDRSQPGQDCRFRVTQLPNGRDYHMSVVRARRNDSGTYLCGAISLAPKVQIKESLRVELRVIERRAEVPTAHPSPSPRPAGQFQTLV

SEQ ID NO: 179 - protein, 150 aa, Artificial Sequence
  PD-1 v77 (1-150)
PGWFLDSPDRPWNPPTISPALLVVTEGDNANFTCSFSNTSESFVLNWYRMSPSNQMDKLAAFPEDRNQPGQDRRFRVTQLPNGRDFHMSVVRARRNDSGTYLCAAISLAPKVQIKESLQVELRVTERRAEVPAAHPSPSLRPAGQFQTLV

SEQ ID NO: 180 - protein, 150 aa, Artificial Sequence
  PD-1 v78 (1-150)
PGWFLDSPDRPWNPPTVSPALLVVTEGDNATFTCSFSNTPESFVLNWYRMSPSNQTDKLAAFPEDRSQPGQDCRFRVTQLPNGRDFHMSVVGARLNDSGTYLCGAISLAPKVQIKESLWAELRVTERRAEVPTAHPSPSPRPAGQFQTLV

SEQ ID NO: 181 - protein, 150 aa, Artificial Sequence
  PD-1 v79 (1-150)
PGWFLDSPDRPGNPPTLSPALLVVTEGDNATFTCSFSNTSESFVLNWYRMSPSNQVDKLAAFPEDRNQPGQDCRFRVTQLPNGRDFHMSVVRARRNDSGTYLCGAISLAPKVQIKESLWAELRVTERRAEEPTAHPSPSPSPAGQFQTLV

SEQ ID NO: 182 - protein, 150 aa, Artificial Sequence
  PD-1 v80 (1-150)
PGWFLDSPDRPWNPPTFSPALLVVTEGDNATFTCSFSNTSESFVLNWYRMSPSNQTDKLAAFPEDRSQPGQDCRFRVTQLPNGRDYHMSVVGARRNDSGTYLCGAISLAPKVQIKESLLVELRVKERRAEVPSAHPSPSPRPAGQFQTLV

SEQ ID NO: 183 - protein, 150 aa, Artificial Sequence
  PD-1 v81 (1-150)
PGWFLDSTDRPWNPPTISPALLVVTEGDNATFTCSFSNTSESFVLNWYRMSPSNQTDKLAAFPEDRNQPGQDCRFRVTQLPNGRDYHMSVVRARRNDSGTYLCAAISLAPKVQIKESLRVELRVTERRAEVPTAHPSPTPRPAGQFQTLV

SEQ ID NO: 184 - protein, 150 aa, Artificial Sequence
  PD-1 v82 (1-150)
PGWFLDSPDRPWNPPTISPALLVVTEGDNATFTCSFSNTPESFVLNWYRMSPSNQTDKLAAFPEDRSQPGQDCRFRVTQLPNGRDFHMSVVRARRNDSGTYLCGAISLAPKVQIKESLWAELRVTERRAEVPTAHPSPSPRPADQFQTLV

SEQ ID NO: 185 - protein, 150 aa, Artificial Sequence
  PD-1 v83 (1-150)
PGWFLDSPDRPWNPPTFSPALIVVTEGDNATFTCSFSNTSESFVLNWYRMSPSNQTDKLAAFPEDRIQPSRDCRFRVTQLPNGRDFHMSVVRARRNDSGTYLCGAITLAPKVQIKESLLVELRVIERRAEVPSAHPSPSPRPAGQFQTLV

SEQ ID NO: 186 - protein, 150 aa, Artificial Sequence
  PD-1 v84 (1-150)
PGWFLDSPDRPWNPPTFSPALLVVTEGDNATFTCSFSNTPESFVLNWYRMSPSNQTDKLAAFPEDRSQPGQDCRFRVTQLPNGRDFHMSVVRARRNDSGTYLCGAISLAPKVQIKESLRVELRVTERRAEVPTAHPSPSPRPAGQFQTLV

SEQ ID NO: 187 - protein, 150 aa, Artificial Sequence
  PD-1 v85 (1-150)
PGWFLDSPDRPWNPPSFSPALLVVTEGDNATFTCSFSNTSESFVLNWYRMSPSNQTDKLAAFPEDRNQPGQDRRFRVTQLPNGRDFHMSVVRARRNDSGTYLCGAISLAPKVQIKESLWAELRVTERRAEVPTAHPSPSPRPAGQFQTLV

SEQ ID NO: 188 - protein, 150 aa, Artificial Sequence
  PD-1 v86 (1-150)
PGWFLDSPDRPWDPPTFSPALLVVTEGDNATFTCSFSNTPESFVLNWYRMSPSNQTDKLAAFPEDRSQPGQDCRFRVTQLPNGRDFHMSVVRARRNDSGTYLCGAISLAPKVQIKESLRVELRVIERRAEVPSAHPSPSPRPAGQFQTLV

SEQ ID NO: 189 - protein, 150 aa, Artificial Sequence
  PD-1 v87 (1-150)
PGWFLDSPDRPWNPPTFSPALLVVTEGDNATFTCSFSNTSESFVLNWYRLSPSNQTDKLAAFPEDRSQPGQDCRFRVTQLPNGRDFHMSVDRARRNDSGTYLCGAISLAPKVQIKESLWAELRVTERRAEVRTAHPSPSPGPAGQFQTLV

SEQ ID NO: 190 - protein, 150 aa, Artificial Sequence
  PD-1 v88 (1-150)
PGWFLDSPDRPWNPPTISPALLVVTEGDNATFTCSFSNTPESFVLNWYRISPSNQTDKLAAFPEDRRQPGQDCRFRVTQLPNGRDFHMSVVRARRNDSGTYLCGAISLAPKVQIKESLLVELRVTERRAEVPTAHPCPSPRPAGQFQTLV

SEQ ID NO: 191 - protein, 150 aa, Artificial Sequence
  PD-1 v89 (1-150)
PGWFLDSPDRPWNPPTFSPALLVVTEGDNATFTCSFSNTPESFVLNWYRMSPSNQTDKLAAFPEDRSQPGQDCRFRVTQLPNGRDFHMSVVRARRNDSGTYLCGAISLAPKVQIKESLWAELRVTERRAEVPTAHPSPSPRPAGQFQTLV

SEQ ID NO: 192 - protein, 150 aa, Artificial Sequence
  PD-1 v90 (1-150)
PGWFLDSPDRPWNPPTISPALLVLTEGDNATFTCSFSNTSESFVLNWYRMSPSNQTDKLAAFPEDRSQPGQDCRFRVTQLPNGRDFHMSVVRARRNDSGTYLCGAISLAPKVQIKESLWAELRVTERRAEVPTAHPSPSPRPAGQFQTLV

SEQ ID NO: 193 - protein, 150 aa, Artificial Sequence
  PD-1 v91 (1-150)
PGWFLDSPDRPWNPPTFSPALLVVTEGDNATFTCSFSNTPESFVLNWYRMSPSNQTDKLAAFPEDRNQPGQDRRFRVTQLPNGRDFHMSVVRVRRNDSGTYLCGAISLAPKVQIKESLRVELRVTERRAEVPTAHPSPSPRPAGQFQTLV

SEQ ID NO: 194 - protein, 150 aa, Artificial Sequence
  PD-1 v92 (1-150)
PGWFLDSPDRPWDPPTISPALLVVTEGDNATFTCSFSNTSESFVLNWYRMSPSNQTDKLAAFPEDRSQPGQDCRFRVTQLPNGRDFHMSVVRARRNDSGTYLCGAISLAPKVQIKESLWAELRVTERRAEVPTAHPSPSPMPAGQFQTLV

SEQ ID NO: 195 - protein, 150 aa, Artificial Sequence
  PD-1 v93 (1-150)
PGWFLDSPDRPWNPPTFSPALLVVTEGDNATFTCSFSNTSESFVLNWYRMSPSNQTDKLAAFPEDRNQPGQDRRFRVTQLPNGRDFHMSVVRARRNDSGTYLCGAISLAPKVQIKESLRVELRVTERRAEVPTAHPSPSPSPAGQFQTLV

SEQ ID NO: 196 - protein, 150 aa, Artificial Sequence
  PD-1 v94 (1-150)
PGWFLDSPDRPRNPPTFSPALLVVTEGDNATFTCSFSNTSESFVLNWYRMSPSNQTDKVAAFPEDHSQPGQDCRFRVTQLPNGRDYHMSLVRARRNDSGTYLCGAISLAPKVQINESLLVELRVTERRAEVPTAHPSPSPRPAGQFQTLV

SEQ ID NO: 197 - protein, 150 aa, Artificial Sequence
  PD-1 v95 (1-150)
PGWFLDSPDRPWNPPTFSPALLVVTEGDNATFTCSLSNTSESFVLNWYRIGPSNQTDKLAAFPEDRSQPGQDRRFRVTQLPNGRDFHMSVVRARRNDSGTYLCGAITLAPMAQIKESLRVELRVTERRAEEPTAHPSPSPRPAGQFQTLV

SEQ ID NO: 198 - protein, 150 aa, Artificial Sequence
  PD-1 v96 (1-150)
PGWFLDSPDRPWNPPTFSPALLVVTEGDNATFTCSFSNTSESFVLNWYRVSPSNQTDKLAAFPEDRSQPGQDCRFRVTQLPNGRDFHMSVVRARRNDSGTYLCGAISLAPKAQIKESLWVELRVIERRAEVPTAHPSPSPGPAGQFQTLV

SEQ ID NO: 199 - protein, 150 aa, Artificial Sequence
  PD-1 v97 (1-150)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLGPKVQIEESLWAELRVTERRAEVPTAHPSPSPRPAGQFQTLV

SEQ ID NO: 200 - protein, 150 aa, Artificial Sequence
  PD-1 v98 (1-150)
PGWFLDSPDRPWNPPTFSPALLVVTEGDNATFTCSFSNTSESFVLNWYRMSPSNRTDKLAAFPEDRSQPGQDCRFHVTQLPNGRDFHMSVVRARRNDSGTYLCGAISLAPKVQIIESLRVELRVTERRAEVPTAHPSPSPRPAGQFQTLV

SEQ ID NO: 201 - protein, 150 aa, Artificial Sequence
  PD-1 v99 (1-150)
PGWFLDSPDRPRNPPTFSPALLVVTEGDNATFTCSFSNTSESFVLNWYRMSPSNQTDKLAAFPEDRSQPGQDCRFRVTQLPNGRDYHMSVVRARLNDSGTYLCGAISLAPKVQIKESLPAELRVTERRAEVPRAHPSPSPRPAGQFQTLV

SEQ ID NO: 202 - protein, 150 aa, Artificial Sequence
  PD-1 v100 (1-150)
PGWFLDSPDRPWNPPTFSPALLVVTEGDNATFTCSFSNTSESFVLNWYRMSPSNQTDKLAAFPEDRNQPGQDYRFRVTQLPNGRDFHMSVVRARRNDSGTYLCGAISLAPKVQIKESLRAELRVTERRAEVPTAHPSPSPRPAGQFQTLV

SEQ ID NO: 203 - protein, 150 aa, Artificial Sequence
  PD-1 v101 (1-150)
PGWFLDSPDRPWNPPTISPALLVVTEGDNATFTCSFSNTPESFVLNWYRMSPSNQSDKLAAFPEDRSQPGQDCRFRVTQLPNGRDFHMSVVRARRNDSGTYLCGAISLAPKVQIKESLRAELRVTERRAEVPTAHPSPSPRPAGQFQTLV

SEQ ID NO: 204 - protein, 150 aa, Artificial Sequence
  PD-1 v102 (1-150)
PGWFLDSPDRPLNSPTFSPALLVVTEGDNATFTCSFSNTSESFVLNWYRVSPSNQTDKLAAFPEDRRQPGQDCRFRVTQLPNGRDFHMSVVRVQRNDSGTYLCGAISLAPTVQIKESLWVELRVTERRAEVPTAHPSPSPRPAGQFQTLV

SEQ ID NO: 205 - protein, 150 aa, Artificial Sequence
  PD-1 v103 (1-150)
PGWFLDSPDRPWNPPTFSPALLVVTEGDNATFTCSLSNTSESFVLNWYRMSPSNQTDKRAAFPEDRNQPGQDCRFRVTQLPNGRDFHMSVVRARRNDSGTYLCGLISLAPKVQIKESLWVELRVTERRAEVPTAHPSPSPRPVGQFQTLV

SEQ ID NO: 206 - protein, 150 aa, Artificial Sequence
  PD-1 v104 (1-150)
PGWFLDSPDRPWNPPTFSPALLVVTEGDNATFTCSFSNTSESFVLNWYRMSPSNQTDKMAAFPKDRSQPGQDCRFRVTQLPNGRDYHMSVVRAQRNDSGTYLCGAISLAPKVQIKESLLVELRVIERRAEVPSAHPSPSPRPAGQFQTLV

SEQ ID NO: 207 - protein, 150 aa, Artificial Sequence
  PD-1 v105 (1-150)
PGWFLDSPDRPWNHPTYSPALLVVTEGDNATFTCSFSNRTESFVLNWYRMSPSNQTDRLAAFPEDRSQPGQDCRFRDTQLPNGRDFHMSVVRARRNDSGTYLCVAISLAPKVRTKESLRAELRVTERRAEVPTAHPSPSPRPVGQFQTLV

SEQ ID NO: 208 - protein, 150 aa, Artificial Sequence
  PD-1 v106 (1-150)
PGWFLDSPDRPWNPPTFSPALLVVTEGDNATFTCSFSNTSESFVLNWYRMSPSNQTVKMAAFPEDRSQSGQDSRFRVTQLPNGRDFHMSVVRARRNDSGTYLCGAISLAPKVQIKESLLVELRVTERRAEVPTVHPSPSPRPAGQFQTLV

SEQ ID NO: 209 - protein, 150 aa, Artificial Sequence
  PD-1 v107 (1-150)
PGWFLDSPDRPWNPPTFSPALLEVTEGDNATFTCSFSNSPESFVLNWYRMSPSNQTDKLAAFPEDRSQPGQDYRFRVTQLPNGRDFHMSVANARRNDSGTYFCGAISLAPKVQIKESLWVELRVTERRAEVPTAHPSPSPRPAGQFQTLV

SEQ ID NO: 210 - protein, 150 aa, Artificial Sequence
  PD-1 v108 (1-150)
PGWFLDSPDRPWNPPAISPALLVVTEGDNATFTCSLSNTSESFVLNWYRMSPSNQTDKLAAFPEDRNQPGQDRRFRVTQLPNGRDFLMSVVGARLNDSGTYLCGAISLAPKVQIKESLWAELRVTERRAEVPTAHPSPSPRPAGQFQTLV

SEQ ID NO: 211 - protein, 150 aa, Artificial Sequence
  PD-1 v109 (1-150)
PGWFLDSPDRPWNPPTFSPALLVVTEGDNATFTCSFSNTSESFVLNWYRMSPSNQTDKLAAFPEDRSQPGQDSRFRVTQLPNGRDFHMSVVRARRNDSGTYLCGVISLAPKVQIKESLWVELRVTERRAEVPAAHPSPSPRPAGQFQTLV

SEQ ID NO: 212 - protein, 150 aa, Artificial Sequence
  PD-1 v110 (1-150)
PGWFLDSPDRPWNSPTFSPALLVVTEGDNATFTCSFSNTSESFVLNWYRLSPSNQTDKVAAFPEDHSQPSQDRRFRVTQLPNGRDFHMSVVRARRNDSGTYLCGAISLAPKVQIKESLRVELRVIERRAEVPTAHPSPSPRPASQFQTLV

SEQ ID NO: 213 - protein, 150 aa, Artificial Sequence
  PD-1 v111 (1-150)
PGWFLDSTDRPWNPPTFSPALLVVTEGDNATFTCSFSNTPESFVLNWYRMSPNNQTDKLAAFPEDRSQPGQDCRFRVTQLPNGRDFHMSVVRARLNDSGTYLCGAISLAPKVQIKESLRVELRVIERMAEVPTAHPSTSPGPAGQFQTLV

SEQ ID NO: 214 - protein, 150 aa, Artificial Sequence
  PD-1 v112 (1-150)
PGWFLDSPDRPWNPPTFSPALLVVTEGDNATFTCSFTNTSESFVLNWYRMSPSNQMDKLAAFPEDRSQPGQDSRFRVTQLPNGRNFHMSVVRARRNDSGTYLCGAISLGPKVQIKESLRVELRVTERRAEVPTAYPSPSPRPSGQFQTLV

SEQ ID NO: 215 - protein, 150 aa, Artificial Sequence
  PD-1 v113 (1-150)
PGWFLDSPDRPWNPPTFSPALLVVTEGDNATFTCSFSNTSESFVLNWYRMSPSNQTDKLAAFPEDRNQPGQDRRFRVTQLPNGRDFHMSVVRVRRNDSGTYLCAAISLAPKVQIKESLQAELRVTESRAEVPTARPSPSPRPAGQFQTLV

SEQ ID NO: 216 - protein, 150 aa, Artificial Sequence
  PD-1 v114 (1-150)
PGWFLDSPDRPWNPPTFSPALLVVTEGDNATFTCSFSNTPESFVLNWYRMSPSNQTDKLAAFPEDRNQPGQDRRFRVTQLPNGRDFHMSVVRARRNDSGTYLCGAISLAPKVQIKESLRVELRVTERRAEVPTAHPSPSPRPAGQFQTLV

SEQ ID NO: 217 - protein, 150 aa, Artificial Sequence
  PD-1 v115 (1-150)
PGWFLDSPDRPWNPPTFSPALLVVTEGDNATFTCSFSNTSESFVLNWYRMSPSNQTDKLAAFPEDRNQPGQDRRFRVTQLPNGRDFHMSVVRVRRNDSGTYLCGAISLAPKVQIKESLWAELRVTERRAEVPTAHPSPSPRPAGQFQTLV

SEQ ID NO: 218 - protein, 150 aa, Artificial Sequence
  PD-1 v116 (1-150)
PGWFLDSPDRPWNPPTFSPALLVVTEGDNATFTCSFSNTSESFVLNWYRMSPSNQTDKLAAFPEDRSQPGQDRRFRVTQLPNGRDFHMSVVRVRRNDSGTYLCGAISLAPKVQIKESLWAELRVTERRAEVPTAHPSPSPRPAGQFQTLV

SEQ ID NO: 219 - protein, 150 aa, Artificial Sequence
  PD-1 v117 (1-150)
PGWFLDSPDRPWNPPTFSPALLVVTEGDNATFTCSFSNTSESFVLNWYRMSPSNQTDKLAAFPEDRNQPGQDRRFRVTQLPNGRDFHMSVVRARRNDSGTYLCGAISLAPKVQIKESLRVELRVTERRAEVPTAHPSPSPRPAGQFQTLV

SEQ ID NO: 220 - protein, 150 aa, Artificial Sequence
  PD-1 v118 (1-150)
PGWFLDSPDRPWDPPTFSPALLVVTEGDNATFTCSFSNTSESFVLNWYRMSPSNQTDKLAAFPEDRSQHGQDRRFRVTQLPNGRDFHMSVVRVRRNDSGTYLCGAISLAPKVQIKESLWAELRVTERRAEVPTAHPSPSPSPAGQFQTLV

SEQ ID NO: 221 - protein, 150 aa, Artificial Sequence
  PD-1 v119 (1-150)
PGWFLDSPDRPWNPPTISPALLVVTEGDNATFTCSFSDTPESFVLNWYRMSPSNQTDKLAAFPEDRNQPGQDRRFRVTQLPNGRDFHMSVVRARRNDSGTYLCGAISLAPKVQIKESLRVELRVTERRAEVPTAHPSPSPRPAGQFQTLV

SEQ ID NO: 222 - protein, 150 aa, Artificial Sequence
  PD-1 v120 (1-150)
PGWFLDSPDRPWDPPTISPALLVVTEGDNATFTCSFSNTPESFVLNWYRMSPSNQMDKLAAFPEDSNQPCQDCRFRVTQLPNGRDFHMSVVRARRNDSGTYLCGAISLAPKVQIKESLRVELRVTERRAEVPTAHPSPSPSPAGQFQTLV

SEQ ID NO: 223 - protein, 150 aa, Artificial Sequence
  PD-1 v121 (1-150)
PGWFLDSPDRPWNPPTFSPALLVVTEGDNATFTCSFSNTPESLVLNWYRMSPSNQTDKLAAFPEDSNQPCQDCRFRVTQLPNGRDFHMSVVRARRNDSGTYLCGAISLAPKVQIKESLLVELRVTERRAEVPTAHPSPSPRPAGQFQTLV

SEQ ID NO: 224 - protein, 150 aa, Artificial Sequence
  PD-1 v122 (1-150)
PGWFLDSPDRPWNPPTFSPALLGVTEGDNATFTCSFSNTTESFVLNWYRMSPSNQTDKLAAFPEDRSQPGQDCRFRVTQLPNGRDFHMSVVRARRNDSGTYLCAAISLAPKVQIKESLLVELRVTERRAEVPTAHPSPSPRPAGQFQTLV

SEQ ID NO: 225 - protein, 150 aa, Artificial Sequence
  PD-1 v123 (1-150)
PGWFLDSPDRPRNPPTFSPALLVVTEGDNATFTCSISNTSESFVLNWYRMSPSYQTDKLAAFPEDRIQPGQDSRFRVTQLPNGRDFHMSVVRVRRNDSGTYLCAAISLAPKVQIQESLWAELRVTERRAEVPTAHPSPSPRPAGQFQTLV

SEQ ID NO: 226 - protein, 150 aa, Artificial Sequence
  PD-1 v124 (1-150)
PGWFLDSPDRPWNPPTFSPALLVVTEGDNATFTCSFSNTPESFVLNWYRLSPSNQTDKLAAFPEDRIQPGQDSRFRVTQLPNGRDFHMSVVGVRRNDSGTYLCGAISLAPKVQIKESLRVELRVTERRAEVPTAHPSPSPSPAGQFQTLV

SEQ ID NO: 227 - protein, 150 aa, Artificial Sequence
  PD-1 v125 (1-150)
PGWFLDSPDRPWNPPTISPALLVVAEGDNATFTCSFSNTPESYVLNWYRMSPSNQTDKLAAFPEDRNQPGQDRRFRVTQLPNGRDYHMSVVRARRNDSGTYLCGAISLAPKVQIKESLWAELRVIERRAEVPTAHPSPSPRPAGQFQTLV

SEQ ID NO: 228 - protein, 150 aa, Artificial Sequence
  PD-1 v126 (1-150)
PGWFLDSPDRPWNPPTISPALLVVTEGDNATFTCSFSNTPESFVLNWYRLSPSNQTDKLAAFPEDRIQPGQDSRFRVTQLPNGRDFHMSVVRARRNDSGTYLCGAISLAPKVQIKESLRVELRVTERRAKVPTAHLSPSPRPAGQFQTLV

SEQ ID NO: 229 - protein, 150 aa, Artificial Sequence
  PD-1 v127 (1-150)
PGWFLDSPDRPRNPPTFSPALLVVTEGDNATFTCSFSNTPESFVLNWYRMSPSNQTDKLAAFPEDRNQPGQDRRFRVTQLPNGRDFHMSVVRVRRNDSGTYLCGAISLAPKVQIKESLRVELRVTERRAEVPTAHPSPSPSPAGQFQTLV

SEQ ID NO: 230 - protein, 150 aa, Artificial Sequence
  PD-1 v128 (1-150)
PGWFLDSPDRPWNPPTISPALLVVTEGDNATFTCSFSNTPESFVLNWYRLSPSNQTDKLAAFPEDRIQPGQDSRFRVTQLPNGRDFHMSVVGVRRNDSGTYLCGAISLAPKVQIKESLRVELRVTERRAEVPTAHPSPSPSPAGQFQTLV

SEQ ID NO: 231 - protein, 150 aa, Artificial Sequence
  PD-1 v129 (1-150)
PGWFLDSPDRPWNPPTISPALLVVTEGDNATFTCSFSNTPESFVLNWYRLSPSNQTDKLAAFPEDRIQPGQDCRFRVTQLPNGRDFHMSVVRARRNDSGTYLCGAISLAPKVQIKESLRVELRVTERRAEVPTAHPSPSPSPAGQFQTLV

SEQ ID NO: 232 - protein, 150 aa, Artificial Sequence
  PD-1 v130 (1-150)
PGWFLDSPDRPWNPPTFSPALLGVTEGDNATFTCSFSNTSESFVLNWYRMSPSNQPDKLAAFPEDRIQPGQDSRFRVTQLPNGRDYHMSVVGARRNDSGTYLCAAISLAPKVQIKESLWAELRVTERRAEVPTAHPSPSPRPDGQFQTLV

SEQ ID NO: 233 - protein, 150 aa, Artificial Sequence
  PD-1 v131 (1-150)
PGWFLDSPDRPWNPPTISPALLVVTEGDNATFTCSFSNTPESFVLNWYRLSPSNQTDKLAAFPEDRIQPGQDSRFRVTQLPNGRDFHMSVVGVRRNDSGTYLCGAISLAPKVQIKESLWAELRVIERRAEVPTAHPSPSPRPAGQFQTLV

SEQ ID NO: 234 - protein, 150 aa, Artificial Sequence
  PD-1 v132 (1-150)
PGWFLDSPVRAWDPPTFSPALLVVTEGDNATFTCSFSNTTESFVLNWYRMSPSNQMDKLAAFPEDRNQPGQDCRFRVTQLPNGRDFHMSVVRARLNDSGTYLCAAISLAPKVQIKESLLVELRVTERRAEVPTAHPSPSPRPAGQFQTLV

SEQ ID NO: 235 - protein, 150 aa, Artificial Sequence
  PD-1 v133 (1-150)
PGWFLDSPDRPWNPPTISPALLVVAEGDNATFTCSFSNTPESYVLNWYRMSPSNQTDKLAAFPEDRNQPGQDCRFRVTQLPNGRDFHMSVVRARRNDSGTYLCGAISLAPKVQIKESLLVELRVTERRAEVPTAHPSPSPRPAGQFQTLV

SEQ ID NO: 236 - protein, 150 aa, Artificial Sequence
  PD-1 v134 (1-150)
PGWFLDSPERPWNPPTISPALLVVTEGDNATFTCSFSNTPESFVLNWYRLSPSNQTDKLAAFPEDRIQPGQDSRFRVTQLPNGRDFHMSMVRARRNDSGAYLCAAISLAPMVQIKESLWVELRVTERRAEVPTAHPSPSPRPDGQFQTLV

SEQ ID NO: 237 - protein, 150 aa, Artificial Sequence
  PD-1 v135 (1-150)
PGWFLDSPDRPWNPPTISPALLVVTEGDNATFTCSFSNTPESFVLNWYRLSPSNQTDKLAAFPEDRIQPGQDSRFRVTQLPNGRDFHMSVVGVRRNDSGTYLCGAISLAPKVQIKESLRVELRVTERRAEVPTAHPSPSPGPAGQFQTLV

SEQ ID NO: 238 - protein, 150 aa, Artificial Sequence
  PD-1 v136 (1-150)
PGWFLDSPDRPWNPPTISPALLVVTEGDNATFTCSFSNTPESFVLNWYRMSPSNQTDKLAAFPEDRNQPGQDCRFRVTQLPNGRDFHMGVVRARLNDSGTYLCGAISLAPKVQIKESLWAELRVIERRAEVPTAHPSPSPRPAGQFQTLV

SEQ ID NO: 239 - protein, 150 aa, Artificial Sequence
  PD-1 v137 (1-150)
PGWFLDSPDRPWNPPTISPALLVVTEGDNATFTCSFSNTPESFVLNWYRLSPSNQTDKLAAFPEDRIQPGQDSRFRVTQLPNGRDFHMSVVGVRRNDSGTYLCGAISLAPMVQIKESLQVELRVTERRAEVPTAHPSPSPRPAGQFQTLV

SEQ ID NO: 240 - protein, 150 aa, Artificial Sequence
  PD-1 v138 (1-150)
PGWFLDSPNRPWNPPTISPALLVVTEGDNANFTCSFSNTPESFVLNWYRLSPSNQTDKLAAFPEDRIQPGQDSRFRVTQLPNGRDFHMSVVGVRRNDSGTYLCGAISLAPKVQIKESLRVELRVTERRAEVPTAHPSPSPSPAGQFQTLV

SEQ ID NO: 241 - protein, 150 aa, Artificial Sequence
  PD-1 v139 (1-150)
PGWFLDSPDRPWDPPTFSPALLVVTEGDNATFTCSFSNTTESFVLNWYRMSPSNQMDKLAAFPEDRNQPGQDCRFRVTQLPNGRDFHMSVVRARLNDSGTYLCAAISLAPRVQIKESLRVELRVIERRAEVPTAHPSPSPRPAGQFQTLV

SEQ ID NO: 242 - protein, 150 aa, Artificial Sequence
  PD-1 v140 (1-150)
PGWFLDSPDRPGNPPTISPALLVVTEGDNATFTCSFSNTPESFVLNWYRLSPSNQTDKLAAFPEDRSQPGQDCRFRVTQLPNGRDFHMSVVRARRNDSGTYLCGAISLAPKVQIKESLRAELRVTERRAEVTTAHPSPSPRPAGQFQTLV

SEQ ID NO: 243 - protein, 150 aa, Artificial Sequence
  PD-1 v141 (1-150)
PGWFLDSPNRPWNPPTISPALLVVTEGDNATFTCSFSNTPESFVLNWYRTSPSNQADKLAAFPEDRSQPSQDRRFRVTQLPNGRDFHMSVVGVRRNDSGTYLCGAISLAPKVQIKESLRVELRVTERRAEVPTAHPSPSPSPAGQFQTLV

SEQ ID NO: 244 - protein, 111 aa, Homo sapiens
  MISC_FEATURE: PD-1 wt (15-125)
PTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVT

SEQ ID NO: 245 - protein, 111 aa, Artificial Sequence
  PD-1 v1, v37 (15-125)
PTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKVQIKESLLVELRVT

SEQ ID NO: 246 - protein, 111 aa, Artificial Sequence
  PD-1 v3 (15-125)
PTFSPALLVVTEGDNATFTYSFSNTSESFVLNWYRMSPSDQTDKLAAFPEDRSQPGQDCRFRVTQLPNGRDFHMSVVRARRNDSGSYLCGAISLAPKVQIKESLRVELRVT

SEQ ID NO: 247 - protein, 111 aa, Artificial Sequence
  PD-1 v4 (15-125)
PTFSPALLVVTEGDNATFTCSFSNTSESFVLNWYRVSPSNQTDKLAAFPEDRNQPGQDCRFRVTQQPNGRDFHMSVVRARRNDSGTYLCGAISLAPKAQIKESLRVELRVT

SEQ ID NO: 248 - protein, 111 aa, Artificial Sequence
  PD-1 v5 (15-125)
PTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKVQIKESLWAELRVT

SEQ ID NO: 249 - protein, 111 aa, Artificial Sequence
  PD-1 v6 (15-125)
PTFSPALLVVTEGDNATFTCSFSNTSESFVLNWYRMSPSNQTDKLAAFPEDRSQPGQDCRFRVTQLPNGHDFLMSVVRARRNDSGTYLCGAISLAPKVQIKESLWAELRVT

SEQ ID NO: 250 - protein, 111 aa, Artificial Sequence
  PD-1 v7 (15-125)
PTFSPALLVVTEGDNATFTCSFSNTSESFVLNWYRMSPSNQTDKLAAFPEDRSQPGRDCRFRVTQLPNGRDFHMSVIRARRNDSGTYLCGAISLAPKVQIKESLLVELRVS

SEQ ID NO: 251 - protein, 111 aa, Artificial Sequence
  PD-1 v8 (15-125)
PTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKVQIEESLRAELRVT

SEQ ID NO: 252 - protein, 111 aa, Artificial Sequence
  PD-1 v9 (15-125)
PTFSPALLVVTEGDNATFTCSFSNTSESFVLNWYRLSPSNQTDKVAAFPEDHSQPGQDCRFRVTQLPNGRDFHMSVVRARRNDSGTYLCGAISLAPKVQIKESLRAELRVT

SEQ ID NO: 253 - protein, 111 aa, Artificial Sequence
  PD-1 v10, v12 (15-125)
PTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLWAELRVT

SEQ ID NO: 254 - protein, 111 aa, Artificial Sequence
  PD-1 v11 (15-125)
PTFSPALLVVTEGDNATFTCSFSNTSESFVLNWYRMSPGNRTDKLAAFPEDRSQPGQDCRFRVTQLPNGRDFHMSVVRARRNDSGTYLCGAISLAPKVQIEESLRVELRVT

SEQ ID NO: 255 - protein, 111 aa, Artificial Sequence
  PD-1 v13 (15-125)
PTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRVELRVI

SEQ ID NO: 256 - protein, 111 aa, Artificial Sequence
  PD-1 v14, v27, v30, v67  (15-125)
PTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKVQIKESLRVELRVT

SEQ ID NO: 257 - protein, 111 aa, Artificial Sequence
  PD-1 v15 (15-125)
PTISPALLVVTEGDNATFTCSFSNTSESFVLNWYRMSPSNQTDKLAAFPEDRSQPGQDCRFRVTQLPNGRDFHMSVVRARRNDSGTYLCGAISLAPEVQIKESLRVELRVT

SEQ ID NO: 258 - protein, 111 aa, Artificial Sequence
  PD-1 v16 (15-125)
PTFTPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLQAELRVT

SEQ ID NO: 259 - protein, 111 aa, Artificial Sequence
  PD-1 v17 (15-125)
PTFSPALLVVTEGDNATFTCSLTNTSESFVLNWYRMSPSNQTDKLAAFPEDRSQPGQDCRFRVTQLPNGRDFHMSVVRARRNDSGTYLCGAISLAPKVQIKESLRAELRVT

SEQ ID NO: 260 - protein, 111 aa, Artificial Sequence
  PD-1 v18 (15-125)
PTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKVQIKESLRAELRVI

SEQ ID NO: 261 - protein, 111 aa, Artificial Sequence
  PD-1 v19 (15-125)
PTFSPALLVVTEGDNATFTCSFSNTSESFVLNWYRISPSNQTDKLAAFPEDRSQPGQDCRFRVTQLPNGRDFHMSVVRARRNDSGTYLCGAISLAPKVQIKESLRVELRVT

SEQ ID NO: 262 - protein, 111 aa, Artificial Sequence
  PD-1 v20 (15-125)
PTFSPALLVVTEGDNATFTCSFSNTSESFVLNWYRMSPSNQTDKLAAFPEDRNQPGQDRRFRVTQLPNGRDFHMSVVRVRRNDSGTYLCGAISLAPKVQIKESLRVELRVT

SEQ ID NO: 263 - protein, 111 aa, Artificial Sequence
  PD-1 v21 (15-125)
PTFSPALLVVTEGDNATFTCSFSNTSESFVLNWYRMSPSNQTDKLAAFPEDRSQPGQGCRFRVTQLPNGRDFHMSVVRARRNDSGTYLCGAISLAPKVQIKESLRVELRVT

SEQ ID NO: 264 - protein, 111 aa, Artificial Sequence
  PD-1 v22 (15-125)
PTFSPALLVVTEGDNATFTCSFSNTSESFVLNWYRMSPSNQTDKLAAFPEDRSQPGQDCRFRVTQLPNGRDFHMSVVRARRDDSGTYLCGAISLAPKVQIKESLRVELRVS

SEQ ID NO: 265 - protein, 111 aa, Artificial Sequence
  PD-1 v23 (15-125)
PTFSPALLVVTEGDNATFTCSFSNTSESFVLNWYRMSPSNQTDKLAAFPEDRSQPGQDCRFRVTQLPNGRDYHMSVVRARRNDSGTYLCGAISLAPKAQIKESLWAELRVI

SEQ ID NO: 266 - protein, 111 aa, Artificial Sequence
  PD-1 v24 (15-125)
PTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLPAELRVT

SEQ ID NO: 267 - protein, 111 aa, Artificial Sequence
  PD-1 v25 (15-125)
PTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPMVQIEESLRAELRVT

SEQ ID NO: 268 - protein, 111 aa, Artificial Sequence
  PD-1 v26 (15-125)
PTFSPALLVVTEGDNATFTCSFSNTSESFVLNWYRMSPSNQTDKLAAFPEDRGQPGQDCRFRVTQLPNGRDFHMSVVRARRNDSGTYLCGAISLAPKVQIKESLRAELRVI

SEQ ID NO: 269 - protein, 111 aa, Artificial Sequence
  PD-1 v28, v29 (15-125)
PTFSPALLVVTEGDNATFTCSFPNTSESFVLNWYRMSPSNQTDKLAAFPEDRSQPGQDCRFRVTQLPNGRDFHMSVVRARRNDSGTYLCGAISLAPKVQIKESLWAELRVT

SEQ ID NO: 270 - protein, 111 aa, Artificial Sequence
  PD-1 v31 (15-125)
PTFSPALLVVTEGDNASFTCSFTNTSESFVLNWYRMSPSNQTDKLAAFPEDRSQPGQDCRFRVTQLPNGRDFHMSVVRARRNDSGTYLCGAISLAPKVQIKESLRAELRVI

SEQ ID NO: 271 - protein, 111 aa, Artificial Sequence
  PD-1 v32 (15-125)
PTFSPALLVVTEGDNATFTCSFTNTSESFVLNWYRMSPSNQTDKLAAFPEDRSQPGQDCRFRVTQLPNGRDFHMSVVRARRNDSGTYLCGAISLAPKVQIKESLRAELRVI

SEQ ID NO: 272 - protein, 111 aa, Artificial Sequence
  PD-1 v33 (15-125)
PTFSPALLVVTEGDNATFTCSFSNTSESFVLNWYRMSPSNQTDKLAAFPEDRSQPGQDCRFRVTQLPNGRDFHMSVVGARRNDSGTYLCGAISLAPKVQIKESLRVELRVT

SEQ ID NO: 273 - protein, 111 aa, Artificial Sequence
  PD-1 v34 (15-125)
PTFSPALLVVTEGDNATFTCSFSNTSESFVLNWYRMSPSNQTDKLAAFPDDRSQPGQDCRFRVTQLPNGRDYHMSVVRARRNDSGTYLCGAISLAPKVQIKESLRVELRVT

SEQ ID NO: 274 - protein, 111 aa, Artificial Sequence
  PD-1 v35 (15-125)
PTFSPALLVVTEGDNATFTCSFSNTSESFVLNWYRMSPSNQTDKLAAFPEDRSQPGQDCRFRVTQLPNGRDFRMSVVRARRNDSGTYLCGAISLAPKVQIKESLWAELRVT

SEQ ID NO: 275 - protein, 111 aa, Artificial Sequence
  PD-1 v36 (15-125)
PTFSPALLVVTEGDNATFTCSFSNTSESFVLNWYRMSPSNQTDKLAAFPEDRSQPGQDCRFRVTQLPNGRDFHMSVVRARRNDSGTYLCGVISLAPKVQIKESLRVELRVT

SEQ ID NO: 276 - protein, 111 aa, Artificial Sequence
  PD-1 v38 (15-125)
PIFSPALLVVTEGDNATFTCSFSNTSESFVLNWYRISPSNQTDKLAAFPEDRSQPGQDCRFRVTQLPNGRDFHMSVVRARRNDSGTYLCGAISLAPKVQIKESLRVELRVT

SEQ ID NO: 277 - protein, 111 aa, Artificial Sequence
  PD-1 v39 (15-125)
PTFSPALLVVTEGDNATFTCSFSNTSESFVLNWYRLSPSNQTDKLAAFPEDRSQPGQDCRFRVTQLPNGRDFHMSVVRARRNDSGTYLCGAISLAPKVQIKESLQVELRVI

SEQ ID NO: 278 - protein, 111 aa, Artificial Sequence
  PD-1 v40 (15-125)
PTFSPALLVVTEGDNATFTCSFSNTSESFVLNWYRMSPSNQTVKLAAFPEDRSQPGQDCRFRVTQLPNGRDFHMSVVRARRNDSGTYLCGAISLAPKVQIKESLRAELRVT

SEQ ID NO: 279 - protein, 111 aa, Artificial Sequence
  PD-1 v41 (15-125)
PTFSPALLVVTEGDNATFTCSFSNTSESFVLNWYRMSPSNQTDKLAAFPEDRNQPGQDCRFRVTQLPNGRDFHMSVVRARRNDSGTYLCGAISLAPKAQIKESLWAELRVT

SEQ ID NO: 280 - protein, 111 aa, Artificial Sequence
  PD-1 v42 (15-125)
PTFSPALLVVTEGDNATFTCSFSNTSESFVLNWYRMSPSNQTDKLAAFPEDRNQPGQDCRFRVTQLPNGRDFHMSVVRARRNDSGTYLCGAISLAPKVQIKESLRVELRVT

SEQ ID NO: 281 - protein, 111 aa, Artificial Sequence
  PD-1 v43 (15-125)
PTFSPALLVVTEGDNATFTCSFSNTSESFVLNWYRMSPSYQTDKLAAFPEDRSQPGQDCRFRVTQLPNGRDFHMSVVRARRNDSGTYLCGAISLAPKVQIKESLRAELRVT

SEQ ID NO: 282 - protein, 111 aa, Artificial Sequence
  PD-1 v44 (15-125)
PTFSPALLVVTEGDNATFTCSFSNTSESYVLNWYRMSPSNQTDKLAAFPEDRSQLGQDCRFRVTQLPNGRDFHMSVVRARRNDSGTYLCGAISLAPKAQIKESLWAELRVT

SEQ ID NO: 283 - protein, 111 aa, Artificial Sequence
  PD-1 v45 (15-125)
PTFSPALLVVTEGDNATFTCSFSNTSESFVLNWYRMSPSYQTDKLAAFPEDRSQPGQDCRFRVTQLPNGRDFHMSVVRARRNDSGTYLCGAISLAPKVQIKESLWAELRVT

SEQ ID NO: 284 - protein, 111 aa, Artificial Sequence
  PD-1 v2, v46 (15-125)
PTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRVELRVT

SEQ ID NO: 285 - protein, 111 aa, Artificial Sequence
  PD-1 v47 (15-125)
PTFSPALLVVTEGDNATFTCSFSNTSESFVLNWYRMSPSNQMDKLAAFPEDRSQPGQDSRFHVTQLPNGRDFHMSVVRARRNDSGTYLCGAISLAPKVQIKESLLVELRVT

SEQ ID NO: 286 - protein, 111 aa, Artificial Sequence
  PD-1 v48 (15-125)
PTISPALLVVTEGDNATFTCSFSNTPDSFVLNWYRMSPSNQTDKLAAFPEDRNQPGQDCRFRVTQLPNGRDFHMSVVRARLNDSGTYLCGAISLAPKVQIKESLRVELRVI

SEQ ID NO: 287 - protein, 111 aa, Artificial Sequence
  PD-1 v49 (15-125)
PTLSPALLVVTEGDNASFTCNFSNTSESFVLNWYRMSPSNQTDKLAAFPEDRSQPGQDCRFRVTQLSNGRDFHMSVVRARRSDSGTYLCGAISLAPKVQIKESLWAELRVT

SEQ ID NO: 288 - protein, 111 aa, Artificial Sequence
  PD-1 v50 (15-125)
PTFSPALLVVTEGDNATFTCSFSNTSESLVLNWYRMSPSNQTDKLAAFPEDRNQPGQDRRFRVTQLPNGRDFHMSVVRARRNDSGTYLCGAISLAPKVQIKESLRVELRVT

SEQ ID NO: 289 - protein, 111 aa, Artificial Sequence
  PD-1 v51 (15-125)
PTFSPALLVVTEGDNATFTCSFSDTSESFVLNWYRMSPSNQTDKLAAFPEDRSQPGQDCRFRVTQLPNGRDFHMSVVRARRNDSGTYLCGAISLAPKVQIKESLQVELRVT

SEQ ID NO: 290 - protein, 111 aa, Artificial Sequence
  PD-1 v52 (15-125)
PTFSPALLVVTEGDNATFTCSFSNTSESFVLNWYRMSPSNQTDKLAAFPEDRNQHGQDRRFRVTPLPNGRDFHMSVDRARRNDSGTYLCGAISLAPKVQIKESLRVELRVT

SEQ ID NO: 291 - protein, 111 aa, Artificial Sequence
  PD-1 v53 (15-125)
PTISPALLVVTEGDNATFTCSFSNTPESFVLNWYRMSPSNQTDKLAAFPEDRNQPGQDCRFRVTRLPNGRDFHMSVVRARRNDSGTYLCGAISLAPKVQIKESLWAELRVI

SEQ ID NO: 292 - protein, 111 aa, Artificial Sequence
  PD-1 v54 (15-125)
PTFSPALLVVTEGDNATFTCSFSNTSESYVLNWYRVSPSNQTDKLAAFPEDRNQPGQDRRFRVTQLPNGRDFHMSVVGARRNDSGTYLCGAISLAPKVQIKESLRVELRVT

SEQ ID NO: 293 - protein, 111 aa, Artificial Sequence
  PD-1 v55 (15-125)
PTLSPALLVVTEGDNATFTCSFSNTSESFVLNWYRMSPSNQMDKLAAFPEDRNQPGQDCRFRVTQLPNGRDFHMSVVRARRNDSGTYLCGAISLAPKVQIKESLWVELRVT

SEQ ID NO: 294 - protein, 111 aa, Artificial Sequence
  PD-1 v56 (15-125)
PTFSPALLVVTEGDNATFTCSFSNTSESFVLNWYRMSPSYQTDKLAAFPEDRNQPGQDCRYRVTQLPNGRDFHMSVDRARLNDSGTYLCAAISLAPKVQIKESLWAELRVT

SEQ ID NO: 295 - protein, 111 aa, Artificial Sequence
  PD-1 v57 (15-125)
PTLSPALLVVTEGDNATFTCSFTNTSESFVLNWYRMSPSNQTDKLAAFPEDRNQPGQDCRFRVSQLPNGRDYHMSVVRARRNDSGTYLCGAISLAPKVQIKESLHVELRVT

SEQ ID NO: 296 - protein, 111 aa, Artificial Sequence
  PD-1 v58 (15-125)
PTFSPALLVVTEGDNATFTCSFSNTPESFVLNWYRMSPSNQTDKLAAFPEDRSQPGQDCRFRVTQLPNGRDFHMSVVRARRNDSGTYLCGAISLAPKVQIKESLLVELRVT

SEQ ID NO: 297 - protein, 111 aa, Artificial Sequence
  PD-1 v59 (15-125)
PTVSPALLVVTEGDNVTFTCSFSNTSVSFVLNWYRMSPSNQTDKLAAFPEDRSQPGQDCRFSVTQLPNGRDFHMSVVRARRNDSGTYLCGAISLAPKVQIKESLQVELRVT

SEQ ID NO: 298 - protein, 111 aa, Artificial Sequence
  PD-1 v60 (15-125)
PTISPALLVVAEGDNATFTCSFSNTSESFVLNWYRVSPTNQTDKLAAFPEDSRQPGQDCRFRVTQLPNGRDFHMSVVRARRNDSGTYLCGAITLAPKVQIKESLWAELRVT

SEQ ID NO: 299 - protein, 111 aa, Artificial Sequence
  PD-1 v61 (15-125)
PTFSPALLVVTEGDNATFTCSFSNTPESFVLNWYRMSPSNQTDKLAAFPEDRNQPGQDRRFRVTQLPNGRDFHMSVVRARLNDSGTYLCAAISLAPKVQIKESLRVELRVT

SEQ ID NO: 300 - protein, 111 aa, Artificial Sequence
  PD-1 v62 (15-125)
PTFSPALLVVTEGDNATFTCSFSNTPESFVLNWYRMSPSNQADKLAAFPEDRNQPGQDRRFRVTQLPNGRDFHMSVVRARRNDSGTYLCGAISLAPKVQIKESLQVELRVT

SEQ ID NO: 301 - protein, 111 aa, Artificial Sequence
  PD-1 v63 (15-125)
PTFSPALLVVTEGDNATFTCSFSNTPESLVLNWYRMSPSNQTDKLAAFPEDRSPPGQDCRFRVTQLPNGRDFHMSVVGARRNDSGTYLCGAISLAPKVQIKESLLVELRVT

SEQ ID NO: 302 - protein, 111 aa, Artificial Sequence
  PD-1 v64 (15-125)
PTLSPALLVVTEGDNATFTCSFSNTSESFVLNWYRMSPSNQTDKLAAFPEDRNQPGLDSRFRVTQLPNGRDFHMSVVRARRNDSGTYLCGAISLAPKVQIKESLQVELRVT

SEQ ID NO: 303 - protein, 111 aa, Artificial Sequence
  PD-1 v65 (15-125)
PTISPALLVVTEGDNATFTCSFSNTPESFVLNWYRMSPSNQTDKLAAFPEDRSQSGQDSRFRVTQLPNGRDFHMSVVRARRSDSGTYLCAAISLAPKVQIKESLRVELRVT

SEQ ID NO: 304 - protein, 111 aa, Artificial Sequence
  PD-1 v66 (15-125)
PTISPALLVVTEGDNATFTCSFSNTPESFVLNWYRMSPSNQTDKLAAFPEDRSQPGQDCRFRVTQLPNGRDFHMSVVRARRNDSGTYLCGAISLAPKVQIKESLLVELRVT

SEQ ID NO: 305 - protein, 111 aa, Artificial Sequence
  PD-1 v68 (15-125)
PTFSPSLLVVTEGDNATFTCSFSNTSESFVLNWYRMSPSNQTDKLAAFPEDRNQPGQDRRFRVTQLPNGRDFHMSVVRAQRNDSGTYLCGAISLAPKVQIKESLQVELRVI

SEQ ID NO: 306 - protein, 111 aa, Artificial Sequence
  PD-1 v69 (15-125)
PTFSPALLVVTEGDNATFTCSFSNTSESFVLNWYRMSPSNQTDKLAAFPEDRNQPGQDRRFRVTQLPNGRDFHMSVVRARLNDSGTYLCGAISLAPKVQIKESLQVELRVI

SEQ ID NO: 307 - protein, 111 aa, Artificial Sequence
  PD-1 v70 (15-125)
PTFSPALLVVTEGDNATFTCSFSNTPESFVLNWYRMSPSNQTDKLAAFPEDRNQPGQDRRFRVTQLPNGRDFHMSVVRARRTDSGTYLCGAISLAPKVQIKESLRVELRVT

SEQ ID NO: 308 - protein, 111 aa, Artificial Sequence
  PD-1 v71 (15-125)
PTFSPAVLVVTEGDNATFTCSFSNTPESFVLNWYRMSPSNQTDKLAAFPEDRSQPGQDCRFRVTQLPNGRDFHMSVVRARLNDSGTYLCAAISLAPKVQIKESLRVELRVT

SEQ ID NO: 309 - protein, 111 aa, Artificial Sequence
  PD-1 v72 (15-125)
PTFSPALLVVTEGDNATFTCSFSNTPERFVLNWYRMSASNQMDKLAAFPEDRSQPGQDCRFRVTQLPNGRDFHMSVVRARRNDSGTYLCGAISLAPKVQIKESLWAELRVI

SEQ ID NO: 310 - protein, 111 aa, Artificial Sequence
  PD-1 v73 (15-125)
PTFSPALLVVTEGDNATFTCSFSNTPESLVLNWYRMSPSNQADKLAAFPEDRNQPGQDSRFRVTQLPNGRDFHMSVVRARRNDSGTYLCGAISLAPKVQIKESLLVELRVT

SEQ ID NO: 311 - protein, 111 aa, Artificial Sequence
  PD-1 v74 (15-125)
PTISPALLVVTEGDNATFTCSFSNTPESFVLNWYRVSPSNQTDKLAAFPEDRNQPGQDSRFRVTQLPNGRDFHMSVVRARLNDSGTYLCAAISLAPKVQIKESLLVELRVT

SEQ ID NO: 312 - protein, 111 aa, Artificial Sequence
  PD-1 v75 (15-125)
PTFSPALLVVTEGDNATFTCSFSNTPESFVLNWYRMSPSNQMDKLAAFPEDRSQPGQDSRFRVTQLPNGRDFHMSVVRARLNDSGTYLCGAISLAPKVQIKESLWAELRVI

SEQ ID NO: 313 - protein, 111 aa, Artificial Sequence
  PD-1 v76 (15-125)
PTISPVLLVVTEGDNATFTCSFSNTSESFVLNWYRMGPSDQTDKLAAFPEDRSQPGQDCRFRVTQLPNGRDYHMSVVRARRNDSGTYLCGAISLAPKVQIKESLRVELRVI

SEQ ID NO: 314 - protein, 111 aa, Artificial Sequence
  PD-1 v77 (15-125)
PTISPALLVVTEGDNANFTCSFSNTSESFVLNWYRMSPSNQMDKLAAFPEDRNQPGQDRRFRVTQLPNGRDFHMSVVRARRNDSGTYLCAAISLAPKVQIKESLQVELRVT

SEQ ID NO: 315 - protein, 111 aa, Artificial Sequence
  PD-1 v78 (15-125)
PTVSPALLVVTEGDNATFTCSFSNTPESFVLNWYRMSPSNQTDKLAAFPEDRSQPGQDCRFRVTQLPNGRDFHMSVVGARLNDSGTYLCGAISLAPKVQIKESLWAELRVT

SEQ ID NO: 316 - protein, 111 aa, Artificial Sequence
  PD-1 v79 (15-125)
PTLSPALLVVTEGDNATFTCSFSNTSESFVLNWYRMSPSNQVDKLAAFPEDRNQPGQDCRFRVTQLPNGRDFHMSVVRARRNDSGTYLCGAISLAPKVQIKESLWAELRVT

SEQ ID NO: 317 - protein, 111 aa, Artificial Sequence
  PD-1 v80 (15-125)
PTFSPALLVVTEGDNATFTCSFSNTSESFVLNWYRMSPSNQTDKLAAFPEDRSQPGQDCRFRVTQLPNGRDYHMSVVGARRNDSGTYLCGAISLAPKVQIKESLLVELRVK

SEQ ID NO: 318 - protein, 111 aa, Artificial Sequence
  PD-1 v81 (15-125)
PTISPALLVVTEGDNATFTCSFSNTSESFVLNWYRMSPSNQTDKLAAFPEDRNQPGQDCRFRVTQLPNGRDYHMSVVRARRNDSGTYLCAAISLAPKVQIKESLRVELRVT

SEQ ID NO: 319 - protein, 111 aa, Artificial Sequence
  PD-1 v82 (15-125)
PTISPALLVVTEGDNATFTCSFSNTPESFVLNWYRMSPSNQTDKLAAFPEDRSQPGQDCRFRVTQLPNGRDFHMSVVRARRNDSGTYLCGAISLAPKVQIKESLWAELRVT

SEQ ID NO: 320 - protein, 111 aa, Artificial Sequence
  PD-1 v83 (15-125)
PTFSPALIVVTEGDNATFTCSFSNTSESFVLNWYRMSPSNQTDKLAAFPEDRIQPSRDCRFRVTQLPNGRDFHMSVVRARRNDSGTYLCGAITLAPKVQIKESLLVELRVI

SEQ ID NO: 321 - protein, 111 aa, Artificial Sequence
  PD-1 v84 (15-125)
PTFSPALLVVTEGDNATFTCSFSNTPESFVLNWYRMSPSNQTDKLAAFPEDRSQPGQDCRFRVTQLPNGRDFHMSVVRARRNDSGTYLCGAISLAPKVQIKESLRVELRVT

SEQ ID NO: 322 - protein, 111 aa, Artificial Sequence
  PD-1 v85 (15-125)
PSFSPALLVVTEGDNATFTCSFSNTSESFVLNWYRMSPSNQTDKLAAFPEDRNQPGQDRRFRVTQLPNGRDFHMSVVRARRNDSGTYLCGAISLAPKVQIKESLWAELRVT

SEQ ID NO: 323 - protein, 111 aa, Artificial Sequence
  PD-1 v86 (15-125)
PTFSPALLVVTEGDNATFTCSFSNTPESFVLNWYRMSPSNQTDKLAAFPEDRSQPGQDCRFRVTQLPNGRDFHMSVVRARRNDSGTYLCGAISLAPKVQIKESLRVELRVI

SEQ ID NO: 324 - protein, 111 aa, Artificial Sequence
  PD-1 v87 (15-125)
PTFSPALLVVTEGDNATFTCSFSNTSESFVLNWYRLSPSNQTDKLAAFPEDRSQPGQDCRFRVTQLPNGRDFHMSVDRARRNDSGTYLCGAISLAPKVQIKESLWAELRVT

SEQ ID NO: 325 - protein, 111 aa, Artificial Sequence
  PD-1 v88 (15-125)
PTISPALLVVTEGDNATFTCSFSNTPESFVLNWYRISPSNQTDKLAAFPEDRRQPGQDCRFRVTQLPNGRDFHMSVVRARRNDSGTYLCGAISLAPKVQIKESLLVELRVT

SEQ ID NO: 326 - protein, 111 aa, Artificial Sequence
  PD-1 v89 (15-125)
PTFSPALLVVTEGDNATFTCSFSNTPESFVLNWYRMSPSNQTDKLAAFPEDRSQPGQDCRFRVTQLPNGRDFHMSVVRARRNDSGTYLCGAISLAPKVQIKESLWAELRVT

SEQ ID NO: 327 - protein, 111 aa, Artificial Sequence
  PD-1 v90 (15-125)
PTISPALLVLTEGDNATFTCSFSNTSESFVLNWYRMSPSNQTDKLAAFPEDRSQPGQDCRFRVTQLPNGRDFHMSVVRARRNDSGTYLCGAISLAPKVQIKESLWAELRVT

SEQ ID NO: 328 - protein, 111 aa, Artificial Sequence
  PD-1 v141 (15-125)
PTISPALLVVTEGDNATFTCSFSNTPESFVLNWYRTSPSNQADKLAAFPEDRSQPSQDRRFRVTQLPNGRDFHMSVVGVRRNDSGTYLCGAISLAPKVQIKESLRVELRVT

SEQ ID NO: 329 - protein, 111 aa, Artificial Sequence
  PD-1 v92 (15-125)
PTISPALLVVTEGDNATFTCSFSNTSESFVLNWYRMSPSNQTDKLAAFPEDRSQPGQDCRFRVTQLPNGRDFHMSVVRARRNDSGTYLCGAISLAPKVQIKESLWAELRVT

SEQ ID NO: 330 - protein, 111 aa, Artificial Sequence
  PD-1 v93, 117 (15-125)
PTFSPALLVVTEGDNATFTCSFSNTSESFVLNWYRMSPSNQTDKLAAFPEDRNQPGQDRRFRVTQLPNGRDFHMSVVRARRNDSGTYLCGAISLAPKVQIKESLRVELRVT

SEQ ID NO: 331 - protein, 111 aa, Artificial Sequence
  PD-1 v94 (15-125)
PTFSPALLVVTEGDNATFTCSFSNTSESFVLNWYRMSPSNQTDKVAAFPEDHSQPGQDCRFRVTQLPNGRDYHMSLVRARRNDSGTYLCGAISLAPKVQINESLLVELRVT

SEQ ID NO: 332 - protein, 111 aa, Artificial Sequence
  PD-1 v95 (15-125)
PTFSPALLVVTEGDNATFTCSLSNTSESFVLNWYRIGPSNQTDKLAAFPEDRSQPGQDRRFRVTQLPNGRDFHMSVVRARRNDSGTYLCGAITLAPMAQIKESLRVELRVT

SEQ ID NO: 333 - protein, 111 aa, Artificial Sequence
  PD-1 v96 (15-125)
PTFSPALLVVTEGDNATFTCSFSNTSESFVLNWYRVSPSNQTDKLAAFPEDRSQPGQDCRFRVTQLPNGRDFHMSVVRARRNDSGTYLCGAISLAPKAQIKESLWVELRVI

SEQ ID NO: 334 - protein, 111 aa, Artificial Sequence
  PD-1 v97 (15-125)
PTFSPALLVVTEGDNATFTCSFSNTSESFVLNWYRMSPSNQTDKLAAFPEDRSQPGQDCRFRVTQLPNGRDFHMSVVRARRNDSGTYLCGAISLGPKVQIEESLWAELRVT

SEQ ID NO: 335 - protein, 111 aa, Artificial Sequence
  PD-1 v98 (15-125)
PTFSPALLVVTEGDNATFTCSFSNTSESFVLNWYRMSPSNRTDKLAAFPEDRSQPGQDCRFHVTQLPNGRDFHMSVVRARRNDSGTYLCGAISLAPKVQIIESLRVELRVT

SEQ ID NO: 336 - protein, 111 aa, Artificial Sequence
  PD-1 v99 (15-125)
PTFSPALLVVTEGDNATFTCSFSNTSESFVLNWYRMSPSNQTDKLAAFPEDRSQPGQDCRFRVTQLPNGRDYHMSVVRARLNDSGTYLCGAISLAPKVQIKESLPAELRVT

SEQ ID NO: 337 - protein, 111 aa, Artificial Sequence
  PD-1 v100 (15-125)
PTFSPALLVVTEGDNATFTCSFSNTSESFVLNWYRMSPSNQTDKLAAFPEDRNQPGQDYRFRVTQLPNGRDFHMSVVRARRNDSGTYLCGAISLAPKVQIKESLRAELRVT

SEQ ID NO: 338 - protein, 111 aa, Artificial Sequence
  PD-1 v101 (15-125)
PTISPALLVVTEGDNATFTCSFSNTPESFVLNWYRMSPSNQSDKLAAFPEDRSQPGQDCRFRVTQLPNGRDFHMSVVRARRNDSGTYLCGAISLAPKVQIKESLRAELRVT

SEQ ID NO: 339 - protein, 111 aa, Artificial Sequence
  PD-1 v102 (15-125)
PTFSPALLVVTEGDNATFTCSFSNTSESFVLNWYRVSPSNQTDKLAAFPEDRRQPGQDCRFRVTQLPNGRDFHMSVVRVQRNDSGTYLCGAISLAPTVQIKESLWVELRVT

SEQ ID NO: 340 - protein, 111 aa, Artificial Sequence
  PD-1 v103 (15-125)
PTFSPALLVVTEGDNATFTCSLSNTSESFVLNWYRMSPSNQTDKRAAFPEDRNQPGQDCRFRVTQLPNGRDFHMSVVRARRNDSGTYLCGLISLAPKVQIKESLWVELRVT

SEQ ID NO: 341 - protein, 111 aa, Artificial Sequence
  PD-1 v104 (15-125)
PTFSPALLVVTEGDNATFTCSFSNTSESFVLNWYRMSPSNQTDKMAAFPKDRSQPGQDCRFRVTQLPNGRDYHMSVVRAQRNDSGTYLCGAISLAPKVQIKESLLVELRVI

SEQ ID NO: 342 - protein, 111 aa, Artificial Sequence
  PD-1 v105 (15-125)
PTYSPALLVVTEGDNATFTCSFSNRTESFVLNWYRMSPSNQTDRLAAFPEDRSQPGQDCRFRDTQLPNGRDFHMSVVRARRNDSGTYLCVAISLAPKVRTKESLRAELRVT

SEQ ID NO: 343 - protein, 111 aa, Artificial Sequence
  PD-1 v106 (15-125)
PTFSPALLVVTEGDNATFTCSFSNTSESFVLNWYRMSPSNQTVKMAAFPEDRSQSGQDSRFRVTQLPNGRDFHMSVVRARRNDSGTYLCGAISLAPKVQIKESLLVELRVT

SEQ ID NO: 344 - protein, 111 aa, Artificial Sequence
  PD-1 v107 (15-125)
PTFSPALLEVTEGDNATFTCSFSNSPESFVLNWYRMSPSNQTDKLAAFPEDRSQPGQDYRFRVTQLPNGRDFHMSVANARRNDSGTYFCGAISLAPKVQIKESLWVELRVT

SEQ ID NO: 345 - protein, 111 aa, Artificial Sequence
  PD-1 v108 (15-125)
PAISPALLVVTEGDNATFTCSLSNTSESFVLNWYRMSPSNQTDKLAAFPEDRNQPGQDRRFRVTQLPNGRDFLMSVVGARLNDSGTYLCGAISLAPKVQIKESLWAELRVT

SEQ ID NO: 346 - protein, 111 aa, Artificial Sequence
  PD-1 v109 (15-125)
PTFSPALLVVTEGDNATFTCSFSNTSESFVLNWYRMSPSNQTDKLAAFPEDRSQPGQDSRFRVTQLPNGRDFHMSVVRARRNDSGTYLCGVISLAPKVQIKESLWVELRVT

SEQ ID NO: 347 - protein, 111 aa, Artificial Sequence
  PD-1 v110 (15-125)
PTFSPALLVVTEGDNATFTCSFSNTSESFVLNWYRLSPSNQTDKVAAFPEDHSQPSQDRRFRVTQLPNGRDFHMSVVRARRNDSGTYLCGAISLAPKVQIKESLRVELRVI

SEQ ID NO: 348 - protein, 111 aa, Artificial Sequence
  PD-1 v111 (15-125)
PTFSPALLVVTEGDNATFTCSFSNTPESFVLNWYRMSPNNQTDKLAAFPEDRSQPGQDCRFRVTQLPNGRDFHMSVVRARLNDSGTYLCGAISLAPKVQIKESLRVELRVI

SEQ ID NO: 349 - protein, 111 aa, Artificial Sequence
  PD-1 v112 (15-125)
PTFSPALLVVTEGDNATFTCSFTNTSESFVLNWYRMSPSNQMDKLAAFPEDRSQPGQDSRFRVTQLPNGRNFHMSVVRARRNDSGTYLCGAISLGPKVQIKESLRVELRVT

SEQ ID NO: 350 - protein, 111 aa, Artificial Sequence
  PD-1 v113 (15-125)
PTFSPALLVVTEGDNATFTCSFSNTSESFVLNWYRMSPSNQTDKLAAFPEDRNQPGQDRRFRVTQLPNGRDFHMSVVRVRRNDSGTYLCAAISLAPKVQIKESLQAELRVT

SEQ ID NO: 351 - protein, 111 aa, Artificial Sequence
  PD-1 v114 (15-125)
PTFSPALLVVTEGDNATFTCSFSNTPESFVLNWYRMSPSNQTDKLAAFPEDRNQPGQDRRFRVTQLPNGRDFHMSVVRARRNDSGTYLCGAISLAPKVQIKESLRVELRVT

SEQ ID NO: 352 - protein, 111 aa, Artificial Sequence
  PD-1 v115 (15-125)
PTFSPALLVVTEGDNATFTCSFSNTSESFVLNWYRMSPSNQTDKLAAFPEDRNQPGQDRRFRVTQLPNGRDFHMSVVRVRRNDSGTYLCGAISLAPKVQIKESLWAELRVT

SEQ ID NO: 353 - protein, 111 aa, Artificial Sequence
  PD-1 v116 (15-125)
PTFSPALLVVTEGDNATFTCSFSNTSESFVLNWYRMSPSNQTDKLAAFPEDRSQPGQDRRFRVTQLPNGRDFHMSVVRVRRNDSGTYLCGAISLAPKVQIKESLWAELRVT

SEQ ID NO: 354 - protein, 111 aa, Artificial Sequence
  PD-1 v118 (15-125)
PTFSPALLVVTEGDNATFTCSFSNTSESFVLNWYRMSPSNQTDKLAAFPEDRSQHGQDRRFRVTQLPNGRDFHMSVVRVRRNDSGTYLCGAISLAPKVQIKESLWAELRVT

SEQ ID NO: 355 - protein, 111 aa, Artificial Sequence
  PD-1 v119 (15-125)
PTISPALLVVTEGDNATFTCSFSDTPESFVLNWYRMSPSNQTDKLAAFPEDRNQPGQDRRFRVTQLPNGRDFHMSVVRARRNDSGTYLCGAISLAPKVQIKESLRVELRVT

SEQ ID NO: 356 - protein, 111 aa, Artificial Sequence
  PD-1 v120 (15-125)
PTISPALLVVTEGDNATFTCSFSNTPESFVLNWYRMSPSNQMDKLAAFPEDSNQPCQDCRFRVTQLPNGRDFHMSVVRARRNDSGTYLCGAISLAPKVQIKESLRVELRVT

SEQ ID NO: 357 - protein, 111 aa, Artificial Sequence
  PD-1 v121 (15-125)
PTFSPALLVVTEGDNATFTCSFSNTPESLVLNWYRMSPSNQTDKLAAFPEDSNQPCQDCRFRVTQLPNGRDFHMSVVRARRNDSGTYLCGAISLAPKVQIKESLLVELRVT

SEQ ID NO: 358 - protein, 111 aa, Artificial Sequence
  PD-1 v122 (15-125)
PTFSPALLGVTEGDNATFTCSFSNTTESFVLNWYRMSPSNQTDKLAAFPEDRSQPGQDCRFRVTQLPNGRDFHMSVVRARRNDSGTYLCAAISLAPKVQIKESLLVELRVT

SEQ ID NO: 359 - protein, 111 aa, Artificial Sequence
  PD-1 v123 (15-125)
PTFSPALLVVTEGDNATFTCSISNTSESFVLNWYRMSPSYQTDKLAAFPEDRIQPGQDSRFRVTQLPNGRDFHMSVVRVRRNDSGTYLCAAISLAPKVQIQESLWAELRVT

SEQ ID NO: 360 - protein, 111 aa, Artificial Sequence
  PD-1 v124 (15-125)
PTFSPALLVVTEGDNATFTCSFSNTPESFVLNWYRLSPSNQTDKLAAFPEDRIQPGQDSRFRVTQLPNGRDFHMSVVGVRRNDSGTYLCGAISLAPKVQIKESLRVELRVT

SEQ ID NO: 361 - protein, 111 aa, Artificial Sequence
  PD-1 v125 (15-125)
PTISPALLVVAEGDNATFTCSFSNTPESYVLNWYRMSPSNQTDKLAAFPEDRNQPGQDRRFRVTQLPNGRDYHMSVVRARRNDSGTYLCGAISLAPKVQIKESLWAELRVI

SEQ ID NO: 362 - protein, 111 aa, Artificial Sequence
  PD-1 v126 (15-125)
PTISPALLVVTEGDNATFTCSFSNTPESFVLNWYRLSPSNQTDKLAAFPEDRIQPGQDSRFRVTQLPNGRDFHMSVVRARRNDSGTYLCGAISLAPKVQIKESLRVELRVT

SEQ ID NO: 363 - protein, 111 aa, Artificial Sequence
  PD-1 v127, v91 (15-125)
PTFSPALLVVTEGDNATFTCSFSNTPESFVLNWYRMSPSNQTDKLAAFPEDRNQPGQDRRFRVTQLPNGRDFHMSVVRVRRNDSGTYLCGAISLAPKVQIKESLRVELRVT

SEQ ID NO: 364 - protein, 111 aa, Artificial Sequence
  PD-1 v128, v135 (15-125)
PTISPALLVVTEGDNATFTCSFSNTPESFVLNWYRLSPSNQTDKLAAFPEDRIQPGQDSRFRVTQLPNGRDFHMSVVGVRRNDSGTYLCGAISLAPKVQIKESLRVELRVT

SEQ ID NO: 365 - protein, 111 aa, Artificial Sequence
  PD-1 v129 (15-125)
PTISPALLVVTEGDNATFTCSFSNTPESFVLNWYRLSPSNQTDKLAAFPEDRIQPGQDCRFRVTQLPNGRDFHMSVVRARRNDSGTYLCGAISLAPKVQIKESLRVELRVT

SEQ ID NO: 366 - protein, 111 aa, Artificial Sequence
  PD-1 v130 (15-125)
PTFSPALLGVTEGDNATFTCSFSNTSESFVLNWYRMSPSNQPDKLAAFPEDRIQPGQDSRFRVTQLPNGRDYHMSVVGARRNDSGTYLCAAISLAPKVQIKESLWAELRVT

SEQ ID NO: 367 - protein, 111 aa, Artificial Sequence
  PD-1 v131 (15-125)
PTISPALLVVTEGDNATFTCSFSNTPESFVLNWYRLSPSNQTDKLAAFPEDRIQPGQDSRFRVTQLPNGRDFHMSVVGVRRNDSGTYLCGAISLAPKVQIKESLWAELRVI

SEQ ID NO: 368 - protein, 111 aa, Artificial Sequence
  PD-1 v132 (15-125)
PTFSPALLVVTEGDNATFTCSFSNTTESFVLNWYRMSPSNQMDKLAAFPEDRNQPGQDCRFRVTQLPNGRDFHMSVVRARLNDSGTYLCAAISLAPKVQIKESLLVELRVT

SEQ ID NO: 369 - protein, 111 aa, Artificial Sequence
  PD-1 v133 (15-125)
PTISPALLVVAEGDNATFTCSFSNTPESYVLNWYRMSPSNQTDKLAAFPEDRNQPGQDCRFRVTQLPNGRDFHMSVVRARRNDSGTYLCGAISLAPKVQIKESLLVELRVT

SEQ ID NO: 370 - protein, 111 aa, Artificial Sequence
  PD-1 v134 (15-125)
PTISPALLVVTEGDNATFTCSFSNTPESFVLNWYRLSPSNQTDKLAAFPEDRIQPGQDSRFRVTQLPNGRDFHMSMVRARRNDSGAYLCAAISLAPMVQIKESLWVELRVT

SEQ ID NO: 371 - protein, 111 aa, Artificial Sequence
  PD-1 v136 (15-125)
PTISPALLVVTEGDNATFTCSFSNTPESFVLNWYRMSPSNQTDKLAAFPEDRNQPGQDCRFRVTQLPNGRDFHMGVVRARLNDSGTYLCGAISLAPKVQIKESLWAELRVI

SEQ ID NO: 372 - protein, 111 aa, Artificial Sequence
  PD-1 v137 (15-125)
PTISPALLVVTEGDNATFTCSFSNTPESFVLNWYRLSPSNQTDKLAAFPEDRIQPGQDSRFRVTQLPNGRDFHMSVVGVRRNDSGTYLCGAISLAPMVQIKESLQVELRVT

SEQ ID NO: 373 - protein, 111 aa, Artificial Sequence
  PD-1 v135, v138 (15-125)
PTISPALLVVTEGDNANFTCSFSNTPESFVLNWYRLSPSNQTDKLAAFPEDRIQPGQDSRFRVTQLPNGRDFHMSVVGVRRNDSGTYLCGAISLAPKVQIKESLRVELRVT

SEQ ID NO: 374 - protein, 111 aa, Artificial Sequence
  PD-1 v139 (15-125)
PTFSPALLVVTEGDNATFTCSFSNTTESFVLNWYRMSPSNQMDKLAAFPEDRNQPGQDCRFRVTQLPNGRDFHMSVVRARLNDSGTYLCAAISLAPRVQIKESLRVELRVI

SEQ ID NO: 375 - protein, 111 aa, Artificial Sequence
  PD-1 v140 (15-125)
PTISPALLVVTEGDNATFTCSFSNTPESFVLNWYRLSPSNQTDKLAAFPEDRSQPGQDCRFRVTQLPNGRDFHMSVVRARRNDSGTYLCGAISLAPKVQIKESLRAELRVT

SEQ ID NO: 376 - protein, 231 aa, Artificial Sequence
  Fc (C5S (C220S), R77C, (R292C),  N82G (N297G), V87C (V302C), L232del (K447del))
EPKSSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 377 - protein, 231 aa, Artificial Sequence
  Fc with C220S/L234A/L235E/G237A/K447del
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 378 - protein, 230 aa, Artificial Sequence
  Fc with C220S/E233P/L234V/L235A/G236del/S267K/K447del
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 379 - protein, 229 aa, Artificial Sequence
  IgG4 Fc
ESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 380 - protein, 229 aa, Artificial Sequence
  IgG4 Fc S228P
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 381 - protein, 232 aa, Artificial Sequence
  IgG1 Fc C220S
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 382 - protein, 232 aa, Artificial Sequence
  Knob Fc
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 383 - protein, 232 aa, Artificial Sequence
  Hole Fc
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 384 - protein, 232 aa, Artificial Sequence
  Stack Fc (homodimeric)
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 385 - protein, 8 aa, Artificial Sequence
  Stuffer
HMSSVSAQ

SEQ ID NO: 386 - protein, 232 aa, Artificial Sequence
  Fc (C5S (C220S), R77C, (R292C),  N82G (N297G), V87C (V302C))
EPKSSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 387 - protein, 232 aa, Artificial Sequence
  Fc with C220S/L234A/L235E/G237A
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 388 - protein, 231 aa, Artificial Sequence
  Fc with C220S/E233P/L234V/L235A/G236del/S267K
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 389 - protein, 19 aa, Artificial Sequence
  VH signal peptide
MGSTAILALLLAVLQGVSA

SEQ ID NO: 390 - protein, 232 aa, Artificial Sequence
  IgG1 Fc
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 391 - protein, 235 aa, Artificial Sequence
  IgG2 Fc
TKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 392 - protein, 122 aa, Artificial Sequence
  PD-1 wt (6-127)
DSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTER

SEQ ID NO: 393 - protein, 122 aa, Artificial Sequence
  PD-1 v142 (6-127)
DSPDRPWNPPTFSPALLVVTEGDNATFTCSFSSTSESFVLNWYRMSPSNQTDKMAAFPEDRSQPGLDCRFRVTQLPNGRDFHMSVVRARRNDSGTYLCGAITLAPKVQIEESLQVELRVTER

SEQ ID NO: 394 - protein, 122 aa, Artificial Sequence
  PD-1 v143 (6-127)
DSPDRPWNPPTFSPALLVVTEGDNATFTCSFSNTSESFVLNWYRVSPSNQTDKMAAFPEDRSQPGQDCRFRVTQLPNGRDFHMSVVRARRNDSGTYLCGAISLAPKVQIKESLQVELRVTER

SEQ ID NO: 395 - protein, 122 aa, Artificial Sequence
  PD-1 v144 (6-127)
DSPDRPWNPPTFSPALLVVTEGDNATFTCSFSNTSESFVLNWYRMSPSNQTDKLAAFPEDRSQPGQDCRFRVTQLSNGRDYHMSVVSARRNDSGTYLCGAITLAPKVQIEESLRVELRVTER

SEQ ID NO: 396 - protein, 122 aa, Artificial Sequence
  PD-1 v145 (6-127)
DSPDRPWNPPTFSPALLVVTEGDNATFTCSFSNTSESFVLNWYRMSPSNQTDKLAAFPEDRSQPGQDRRFRVTQLPNGQDYHMSVVRARRNDSGTYLCGAITLAPKVQIDESLRVELRVTER

SEQ ID NO: 397 - protein, 122 aa, Artificial Sequence
  PD-1 v146 (6-127)
DSPDRPGNPPTFSPALLVVTEGDNATFTCSFSNTSESFVLNWYRTSPNNQTDKLAAFPEDRRQPSQDRRFRVTQLPNGRDFHMSVVRARRNDSGTYLCVAISLAPKVQIEESLWAELRVTER

SEQ ID NO: 398 - protein, 122 aa, Artificial Sequence
  PD-1 v147 (6-127)
DSPDRPWNPPTFSPALLVVTEGDNAIFTCSYSNTSESYVLNWYRMSPSNQTDKLAAFPEDRNQPSQDRRFRVTQLPNGRDFHMSMVRARRNDSGTYLCGAISLAPKVQIKESLWAELRVTER

SEQ ID NO: 399 - protein, 122 aa, Artificial Sequence
  PD-1 v148 (6-127)
DSPDRPWNPPTFSPALLVVTEGDNATFTCSFSNTSESFVLNWYRMSPSNQTDKLAAFPEDRSQPGQDCRFSVTQLPNGRDFHMSVVRARRNDSGTYLCGAITLAPNVQINESLRVELRVTER

SEQ ID NO: 400 - protein, 122 aa, Artificial Sequence
  PD-1 v149 (6-127)
DSPDRPWNPPTFSPALLVVTEGDNATFTCSFSNTSESFVLNWYRMSPSNQTDKLAAFPEDRSQPGQDCRFRVTQLPNGRDYHMSVVRARRNDSGTYLCGAISLAPKVQIKESLWVELRVTER

SEQ ID NO: 401 - protein, 122 aa, Artificial Sequence
  PD-1 v150 (6-127)
DSPDRPWSPPTFSPALLVVTEGDNATFTCSFSNTSESFVLNWYRISPSNQTDKLAAFPEDRSQPGQDCRFSVTQLPNGRDFHMSVVRARRNDSGTYLCGAITLAPKVQINESLWVELRVTER

SEQ ID NO: 402 - protein, 122 aa, Artificial Sequence
  PD-1 v151 (6-127)
DSPDRPWNHPSFSPALLVVTEGDNATFTCSFSNTSESFVLNWYRLSPSNQTDKLAAFPEDRSQPGQDRRFRVTQLPNGQDYHMSVVRARRNDSGTYLCGAITLAPKVQIEESLRVELRVTER

SEQ ID NO: 403 - protein, 122 aa, Artificial Sequence
  PD-1 v152 (6-127)
DSPDRPWNPPTLSPALLVVAEGDNATFTCSFSNTSESFVLNWYRMSPSNQTDKMAAFPKDRSQPGQDCRFRVTQLPNGRDYHMSVVRAQRNDSGTYLCGAITLAPKVQINESLWVELRVTER

SEQ ID NO: 404 - protein, 122 aa, Artificial Sequence
  PD-1 v153 (6-127)
DSPDRPWNPPTFSPALLVVTEGDNATFTCSFSNTSESFVLNWYRMSPSNQTDKLAAFPEDRSQPGRDCRFRVTQLPNGRDYHMSVVRARRNDSGTYLCGAISLAPKVQIEESLQVELRVTER

SEQ ID NO: 405 - protein, 122 aa, Artificial Sequence
  PD-1 v154 (6-127)
DSPDRPWNPPTFSPALLVVTEGDNATFTCSFSNTSESFVLNWYRMSPSNQTDKLAAFPEDRSQPGQDCRFSVTQLPNGRDFHMSVVRARRNDSGTYLCGAITLAPKVQINESLWVELRVTER

SEQ ID NO: 406 - protein, 122 aa, Artificial Sequence
  PD-1 v155 (6-127)
DSPDRPWNPPTFSPALLVVTEGDNATFTCSFSNTSESFVLNWYRISPSNQTDKLAAFPEDRSQPGQDCRFRVTQLPNGRDFHMSVVRARRNDSGTYLCGAISLAPKVQIDESLRVELRVTER

SEQ ID NO: 407 - protein, 122 aa, Artificial Sequence
  PD-1 v156 (6-127)
DSPDRPWNPPTFSPALLVVTEGDNATFTCSFSNTSESFVLNWYRVSPSNQTDKLAAFPEDRSQPGQDCRFRVTQLSNGRDYHMSVVSARRNDSGTYLCGAITLAPKVQIEESLRVELRVTER

SEQ ID NO: 408 - protein, 122 aa, Artificial Sequence
  PD-1 v157 (6-127)
DSPDRPWNPPTFSPALLVVTEGDNATFTCSFSNTSESFVLNWYRISPSNQTDKLAAFPEDRNQPRQDCRFRVTQLPNGRDFHMSVVRARRNDSGTYLCGAISLAPTVQIKESLWVELRVTER

SEQ ID NO: 409 - protein, 122 aa, Artificial Sequence
  PD-1 v158 (6-127)
DSPDRPWNHPSFSPALLVVTEGDNATFTCSFSNTSESFVLNWYRLSPSNQTDKLAAFPEDRSQPGQDCRFRVTQQPNGRDFHMSVVRARRNDSGTYLCGAISLAPMAQIKESLQVELRVTER

SEQ ID NO: 410 - protein, 122 aa, Artificial Sequence
  PD-1 v159 (6-127)
DSPDRPWNPPTFSPALLVVTEGDNAIFTCSYSNTSESFVLNWYRMSPSNQTDKLAAFPKDRSQPGQDCRFRVTQLPNGRDFHMSVVRARRNDSGTYLCGAISLAPKVQIEESLQVELRVTER

SEQ ID NO: 411 - protein, 122 aa, Artificial Sequence
  PD-1 v160 (6-127)
DSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAITLAPKVQIKESLWVELRVTER

SEQ ID NO: 412 - protein, 122 aa, Artificial Sequence
  PD-1 v161 (6-127)
DSPDRPWNPPTFSPALLVVTEGDNATFTCSFSNTSESFVLNWYRMSPSNQSDKLAAFPEDRSQPGQDCRFRVTQLPNGRDFHMSVVRARRNDSGTYLCGAISLAPKVQIEESLRVELRVTER

SEQ ID NO: 413 - protein, 122 aa, Artificial Sequence
  PD-1 v162 (6-127)
DSPDRPWNPPTFSPALLVVTEGDNATFTCSFSNTSESFVLNWYRMSPSNQSDKLAAFPEDRSQPGQDCRFRVTQLPNGRDFHMSVVRARRNDSGTYLCGAISLAPKVQIKESLWAELRVTER

SEQ ID NO: 414 - protein, 122 aa, Artificial Sequence
  PD-1 v163 (6-127)
DSPDRPWNPPTFSPALLVVTEGDNATFTCSFSNTSESFVLNWYRMSPSNQSDKLAAFPEDRSQPGQDCRFRVTQLPNGRDFHMSVVRARRNDSGTYLCGAISLAPKAQIKESLRAELRVTER

SEQ ID NO: 415 - protein, 122 aa, Artificial Sequence
  PD-1 v164 (6-127)
DSPDRPWNPPTFSPALLVVTEGDNATFTCSFSNTSESFVLIWNRMSPSNQTYKLAAFPEDRCQPGQDCRFRVTQLPNGRDFHMSLVRARRNDSGTYLCGAISLAPKVQIKESLRAELRVTER

SEQ ID NO: 416 - protein, 122 aa, Artificial Sequence
  PD-1 v165 (6-127)
DSPDRPWNPPTFSPALLVVTEGDNATFTCSFSNTSESFVLNWYRMSPSNQSDKLAAFPEDRSQPGQDCRFRVTQLPNGRDFHMSVVRARRNDSGTYLCGAISLAPKVQIKESLPAELRVTER

SEQ ID NO: 417 - protein, 122 aa, Artificial Sequence
  PD-1 v166 (6-127)
DSPDRPWNHPTISPALLVVTEGDNATFTCSFSNTSESFMLNWYRMSPSNQTDKLAAFPEDRSQPGQDCRFRVTQLPNGRDFHMSVVRARRNDSGTYLCGAISLAPKVQIEESLRVELRVTER

SEQ ID NO: 418 - protein, 122 aa, Artificial Sequence
  PD-1 v167 (6-127)
DSPDRPWNPPTFSPALLVVTEGDNATFTCSFSSTSESFVLNWYRMSPSNQSDKLAAFPEDRSQPGQDCRFRVTQLPNGRDFHMSVVRARRNDSGTYLCGAISLAPKVQIEESLRVELRVTER

SEQ ID NO: 419 - protein, 122 aa, Artificial Sequence
  PD-1 v168 (6-127)
DSPDRPWNPPTFSPALLVVTEGDNATFTCSFSNTSEGFVLNWYRLSPSNQTDKLAAFPEDRSQSGQDCRFRVTQLPNGRDYHMSVVRARRNDSGTYLCGAISLAPKVQIEESLRAELRVTER

SEQ ID NO: 420 - protein, 122 aa, Artificial Sequence
  PD-1 v169 (6-127)
DSPDRPWNHPTFSPALLVVTEGDNATFTCSFSNTSESFVLNWYRMSPSNQSDKLAAFPEDRSQPGQDCRFRVTQLPNGRDFHMSVVRARRNDSGTYLCGAISLAPKVQIEESLRVELRVTER

SEQ ID NO: 421 - protein, 122 aa, Artificial Sequence
  PD-1 v170 (6-127)
DSPDRPWSPPTFSPALLVVTEGDNATFTCSFSNTSESFVLNWYRMSPSNQTDKLAAFPEDRNQPCQDCRFRVTQLPNGRDYHMNVDRARRNDSGTYLCGAISLAPKVQIKESLLVELRVTER

SEQ ID NO: 422 - protein, 122 aa, Artificial Sequence
  PD-1 v171 (6-127)
DSPDRPGNPPTFSPALLVVTEGDNATFTCSFSNTSESFVLNWYRMSPSNQTDKLAAFPEDRNQPGRDCRFRVTQLPNGRDYHMSVVRARRNDSGTYLCGAISLAPMVQIQESLWAELRVTER

SEQ ID NO: 423 - protein, 122 aa, Artificial Sequence
  PD-1 v172 (6-127)
DSPDRPWNPPTFSPALLVVTEGDNATFTCSFSNTSESFVLNWYRMSPSNQTDKLAAFPEDRNQPGQDRRFRVTQLPNGRDFHMSVDRARRNDSGTYLCGAITLAPMVQIQESLWAELRVTER

SEQ ID NO: 424 - protein, 122 aa, Artificial Sequence
  PD-1 v173 (6-127)
DSPDRPWSPPTFSPALLVVTEGDNATFTCSFSNTSESFVLNWYRISPSNQTDKLAAFPEDRSQPGQDCRFSVTQLPNGRDFHMSVVRARRNDSGTYLCGAITLAPMVQIQESLWAELRVTER

SEQ ID NO: 425 - protein, 122 aa, Artificial Sequence
  PD-1 v174 (6-127)
DSPDRPWNPPTFSPALLVVTEGDNATFICSFSNTSESFVLNWYRMSPSNQTDKLAAFPEDRNQPSQDCRFRVTQLPNGRDFHMSVVRARRNDSGTYLCGAITLAPNVQIEESLWAELRVTER

SEQ ID NO: 426 - protein, 122 aa, Artificial Sequence
  PD-1 v175 (6-127)
DSPDRPWNPPTFSPALLVVTEGDNATFTCSFSNTSESFVLNWYRMSPSNQTDKLAAFPEDRSQLGQDCRFRVTQLPNGRDYHMSMVRARRNDSGIYLCGAITLAPNVQINESLRVELRVTER

SEQ ID NO: 427 - protein, 122 aa, Artificial Sequence
  PD-1 v176 (6-127)
DSPDRPWNPPTLSPALLVVAEGDNATFTCSFSNTSESFVLNWYRMSPSNQTDKLAAFPEDRSQLGQDCRFRVTQLPNGRDYHMSMVRARRNDSGIYLCGAITLAPNVQINESLRVELRVTER

SEQ ID NO: 428 - protein, 122 aa, Artificial Sequence
  PD-1 v177 (6-127)
DSPDRPWNPPTFSPALLVVTEGDNATFICSFSNTSESFVLNWYRISPSNQTDKLAAFPEDRSQPGQDCRFSVTQLPNGRDYHMSVVRARRNDSGTYLCGAITLAPKVQINESLWVELRVTER

SEQ ID NO: 429 - protein, 122 aa, Artificial Sequence
  PD-1 v178 (6-127)
DSPDRPWSPPTFSPALLVVTEGDNATFTCSFSNTSESFVLNWYRMSPSNQTDKLAAFPEDRNQPGQDRRFRVTQLPNGRDYHMSVVRARRNDSGTYLCGAITLAPKVRIEESLRVELRVTER

SEQ ID NO: 430 - protein, 122 aa, Artificial Sequence
  PD-1 v179 (6-127)
DSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTER

SEQ ID NO: 431 - protein, 122 aa, Artificial Sequence
  PD-1 v180 (6-127)
DSPDRPWNPPTLSPALLVVAEGDNATFTCSFSNTSESFVLNWYRMSPSNQTDKLAAFPEDRNQPGQDRRFRVTQLPNGQDYHMSVVRVRRNDSGTYLCGAISLAPKVQIEESLWAELRVTER

SEQ ID NO: 432 - protein, 122 aa, Artificial Sequence
  PD-1 v181 (6-127)
DSPDRPWNPPTFSPALLVVTEGDNATFTCSFSNTSESFVLNWYRMSPSNQSDKLAAFPEDRSQPGQDCRFRVTQLPNGRDFHMSVVRARRNDSGTYLCGAISLAPKVQIEESLRAELRVTER

SEQ ID NO: 433 - protein, 122 aa, Artificial Sequence
  PD-1 v182 (6-127)
DSPDRPWNPPTFSPALLVVTEGDNATFTCSFSNTSESFVLNWYRMSPSNQTDKLAAFPEDRSQLGQDCRFRVTQLPNGRDFHMSVDRARRNDSGTYLCGAISLAPKVQINESLWVELRVTER

SEQ ID NO: 434 - protein, 122 aa, Artificial Sequence
  PD-1 v183 (6-127)
DSPDRPWSPPTFSPALLVVTEGDNATFTCSFSNTSDSFVLNWYRISPSNQTDKLAAFPEDRSQPVQNCRFRVTQLPNGRDYHMSVVRAQRNDSGTYLCGAISLAPKVQIKESLLVELRVTER

SEQ ID NO: 435 - protein, 122 aa, Artificial Sequence
  PD-1 v184 (6-127)
DSPDRPWNPPTFSPALLVVTEGDNATFTCSFSNTSESFVLNWYRISPSNQTDKLAAFPEDRSQLGQDCRFRVTQLPNGRDYHMSMVRARRNDSGIYLCGAITLAPNVQINESLRVELRVTER

SEQ ID NO: 436 - protein, 122 aa, Artificial Sequence
  PD-1 v185 (6-127)
DSPDRPWNPPTFSPALLVVTEGDNATFTCSFSNTSESFVLNWYRISPSNQTDKLAAFPEDRSQPGQDRRFRVTQLPNGRDFHMSVVRARRNDSGTYLCGAITLAPNVQINESLRVELRVTER

SEQ ID NO: 437 - protein, 122 aa, Artificial Sequence
  PD-1 v186 (6-127)
DSPDRPWNPPTFSPALLVVTEGDNATFTCSFSNTSESFVLNWYRMSPSNQTDKLAAFPEDRSQPGQDCRFRVTQLPNGRDYHMSVVRARRNDSGTYLCGAISLAPKVQINESLWAELRVTER

SEQ ID NO: 438 - protein, 122 aa, Artificial Sequence
  PD-1 v187 (6-127)
DSPDRPWNPPTFSPALLVVTEGDNATFTCSFSNTSESFVLNWYRISPSNQTDKLAAFPEDRNQPGQDRRFRVTQLPNGRDYHMSVVRARLNDSGTYLCGAITLAPKVQINESLWAELRVTER

SEQ ID NO: 439 - protein, 122 aa, Artificial Sequence
  PD-1 v188 (6-127)
DSPDRPWNPPTFSPALLVVTEGDNATFTCSFSNTSESFVLNWYRLSPSNQTDKLAAFPEDRSRSGQDCRFRVTQLPNGRDYHMSVVRARRNDSGTYLCGAITLAPKVQINESLWAELRVTER

SEQ ID NO: 440 - protein, 122 aa, Artificial Sequence
  PD-1 v189 (6-127)
DSPDRPWNPPTFSPALLVVTEGDNATFTCSFSTTSESFVLNWYRMSPSNQTDKLAAFPEDRSQPGQDCRFRVTQLPNGRDFHMSVVRARRNDSGTYLCGAISLAPKVQINESLLVELRVTER

SEQ ID NO: 441 - protein, 122 aa, Artificial Sequence
  PD-1 v190 (6-127)
DSPDRPWNPPTFSPALLVVTEGDNATFTCSFSNTSESFVLNWYRMSPSNQTDKLAAFPEDRNQPGHDCRFRVTQLPNGRDYHMSVVRARLNDSGTYLCGAITLAPKVQINESLWAELRVTER

SEQ ID NO: 442 - protein, 122 aa, Artificial Sequence
  PD-1 v191 (6-127)
DSPDRPWNPPTFSPTLLVVTEGENATFTCSLSNTSESFVLNWYRISPSNQTDKLAAFPEDRSRSGQDCRFRVTQLPNGRDYHMSVVRARRNDSGTYLCGAISLAPKVQIKESLLVELRVTER

SEQ ID NO: 443 - protein, 122 aa, Artificial Sequence
  PD-1 v192 (6-127)
DSPDRPWNPPTFSPALLVVTEGDNATFTCSFSNTSESFVLNWYRISPSNQTDKLAAFPEDRNQPGQDRRFRVTQLPNGRDYHMSVVRARLNDSGTYLCGAISLAPKVWIKESLLVELRVTER

SEQ ID NO: 444 - protein, 122 aa, Artificial Sequence
  PD-1 v193 (6-127)
DSPDRPWNPPTFSPALLVVTEGDNATFTCSFSNTSESFVLNWYRMSPSNQTDKMAAFPEDRNQPGLDRRFRVTQLPNGRDFHMSVVRARLNDSGTYLCGAITLAPKVQINESLWAELRVTER

SEQ ID NO: 445 - protein, 122 aa, Artificial Sequence
  PD-1 v194 (6-127)
DSPDRPWNPPTFSPALLVVTEGDNATFTCSFSNTSESFVLNWYRMSLNNQTDKLAAFPEDRSQPGQDSRFRVTQLPNGRDFHMSVVRARRNDSGTYLCGAISLAPKVQIKDSLWAELRVTER

SEQ ID NO: 446 - protein, 122 aa, Artificial Sequence
  PD-1 v195 (6-127)
DSPDRPWNPPTFSPALLVVTEGDNATFTCSFSNTSESFVLNWYRMSPSNQTDKLAAFPEDRSQPGRDRRFRVTQLPNGRDFHMSVVRARRNDSGTYLCGAISLAPKVQINESLLVELRVTER

SEQ ID NO: 447 - protein, 122 aa, Artificial Sequence
  PD-1 v196 (6-127)
DSPDRPLNPPTFSPTLLVVTEGDDATFTCSFPNTSESFVLNWYRMSPSNQTDKMAAFPEDRSRSGQDCRFRVTQLPNGRDYHMSVVRARRNDSGTYLCGAISLAPKVQIKESLLVELRVTER

SEQ ID NO: 448 - protein, 122 aa, Artificial Sequence
  PD-1 v197 (6-127)
DSPDRPWNPPTFSPALLVVTEGDNATFTCSFSNTSESFVLIWFRMSPSNQTVKLAAFPEDRSQLGQDCRFRVTQLPNGRDFHMSVVRARRNDSGTYLCGAISLAPKVQINESLWAELRVTER

SEQ ID NO: 449 - protein, 122 aa, Artificial Sequence
  PD-1 v198 (6-127)
DSPDRPWNPPTFSPALLVVTEGDNATFTCSFSNTSESFVLNWYRISPSNQTDKLAAFPEDRNQPGQDRRFRVTQLPNGRDYHMSVVRARLNDSGTYLCGAITLAPKVQIQESLQVELRVTER

SEQ ID NO: 450 - protein, 122 aa, Artificial Sequence
  PD-1 v199 (6-127)
DSPDRPWNPPTFSPALLVVTEGDNATFTCSFSNTSESFVLNWYRMSPSDQTDKLAAFPEDRSQHGQDRRFRVTQLPNGRDYHMSVVRARLNDSGTYLCGAITLAPKVQINESLWAELRVTER

SEQ ID NO: 451 - protein, 122 aa, Artificial Sequence
  PD-1 v200 (6-127)
DSPDRPWNPPTFSPALLVVTEGDNATFTCSFSNTSESFVLNWYRMSPSNQSDKLAAFPEDRSQPGKDCRFRVTQLPNGRDYHMSVVRARLNDSGTYLCGAITLAPKVQINESLWAELRVTER

SEQ ID NO: 452 - protein, 20 aa, Artificial Sequence
  T2A
SGEGRGSLLTCGDVEENPGP

SEQ ID NO: 453 - protein, 122 aa, Artificial Sequence
  PD-1 v201 (6-127)
DSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTER

SEQ ID NO: 454 - protein, 122 aa, Artificial Sequence
  PD-1 v101 (6-127)
DSPDRPWNPPTISPALLVVTEGDNATFTCSFSNTPESFVLNWYRMSPSNQSDKLAAFPEDRSQPGQDCRFRVTQLPNGRDFHMSVVRARRNDSGTYLCGAISLAPKVQIKESLRAELRVTER

SEQ ID NO: 455 - protein, 122 aa, Artificial Sequence
  PD-1 v94 (6-127)
DSPDRPRNPPTFSPALLVVTEGDNATFTCSFSNTSESFVLNWYRMSPSNQTDKVAAFPEDHSQPGQDCRFRVTQLPNGRDYHMSLVRARRNDSGTYLCGAISLAPKVQINESLLVELRVTER

SEQ ID NO: 456 - protein, 122 aa, Artificial Sequence
  PD-1 v89 (6-127)
DSPDRPWNPPTFSPALLVVTEGDNATFTCSFSNTPESFVLNWYRMSPSNQTDKLAAFPEDRSQPGQDCRFRVTQLPNGRDFHMSVVRARRNDSGTYLCGAISLAPKVQIKESLWAELRVTER

SEQ ID NO: 457 - protein, 115 aa, Artificial Sequence
  PD-1 wt (13-127)
NPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTER

SEQ ID NO: 458 - protein, 115 aa, Artificial Sequence
  PD-1 v201 (13-127)
NPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTER

SEQ ID NO: 459 - protein, 115 aa, Artificial Sequence
  PD-1 v101 (13-127)
NPPTISPALLVVTEGDNATFTCSFSNTPESFVLNWYRMSPSNQSDKLAAFPEDRSQPGQDCRFRVTQLPNGRDFHMSVVRARRNDSGTYLCGAISLAPKVQIKESLRAELRVTER

SEQ ID NO: 460 - protein, 115 aa, Artificial Sequence
  PD-1 v94 (13-127)
NPPTFSPALLVVTEGDNATFTCSFSNTSESFVLNWYRMSPSNQTDKVAAFPEDHSQPGQDCRFRVTQLPNGRDYHMSLVRARRNDSGTYLCGAISLAPKVQINESLLVELRVTER

SEQ ID NO: 461 - protein, 115 aa, Artificial Sequence
  PD-1 v89 (13-127)
NPPTFSPALLVVTEGDNATFTCSFSNTPESFVLNWYRMSPSNQTDKLAAFPEDRSQPGQDCRFRVTQLPNGRDFHMSVVRARRNDSGTYLCGAISLAPKVQIKESLWAELRVTER

SEQ ID NO: 462 - protein, 122 aa, Artificial Sequence
  PD-1 wt (6-127) C73A
DSPDRPWNPPTFSPALLVVTEGDNATFTCSFSNTSESFVLNWYRMSPSNQTDKLAAFPEDRSQPGQDARFRVTQLPNGRDFHMSVVRARRNDSGTYLCGAISLAPKAQIKESLRAELRVTER

SEQ ID NO: 463 - protein, 122 aa, Artificial Sequence
  PD-1 v201 (6-127) C73A
DSPDRPWNPPTFSPALLVVTEGDNATFTCSFSNTSESFHVIWHRESPSGQTDTLAAFPEDRSQPGQDARFRVTQLPNGRDFHMSVVRARRNDSGTYVCGVISLAPKIQIKESLRAELRVTER

SEQ ID NO: 464 - protein, 122 aa, Artificial Sequence
  PD-1 wt (6-127) L59C
DSPDRPWNPPTFSPALLVVTEGDNATFTCSFSNTSESFVLNWYRMSPSNQTDKCAAFPEDRSQPGQDCRFRVTQLPNGRDFHMSVVRARRNDSGTYLCGAISLAPKAQIKESLRAELRVTER

SEQ ID NO: 465 - protein, 71 aa, Artificial Sequence
  CD8-derived hinge and transmembrane domain
KPTTTPAPRPPTPAPTIASQPLSLRPEASRPAAGGAVHTRGLDFASDIYIWAPLAGTCGVLLLSLVITLYC

SEQ ID NO: 466 - protein, 122 aa, Artificial Sequence
  PD-1 v101 (6-127) L59C
DSPDRPWNPPTISPALLVVTEGDNATFTCSFSNTPESFVLNWYRMSPSNQSDKCAAFPEDRSQPGQDCRFRVTQLPNGRDFHMSVVRARRNDSGTYLCGAISLAPKVQIKESLRAELRVTER

SEQ ID NO: 467 - protein, 122 aa, Artificial Sequence
  PD-1 v94 (6-127) L59C
DSPDRPRNPPTFSPALLVVTEGDNATFTCSFSNTSESFVLNWYRMSPSNQTDKCAAFPEDHSQPGQDCRFRVTQLPNGRDYHMSLVRARRNDSGTYLCGAISLAPKVQINESLLVELRVTER

SEQ ID NO: 468 - protein, 122 aa, Artificial Sequence
  PD-1 v89 (6-127) L59C
DSPDRPWNPPTFSPALLVVTEGDNATFTCSFSNTPESFVLNWYRMSPSNQTDKCAAFPEDRSQPGQDCRFRVTQLPNGRDFHMSVVRARRNDSGTYLCGAISLAPKVQIKESLWAELRVTER

SEQ ID NO: 469 - protein, 122 aa, Artificial Sequence
  PD-1 wt (6-127) L60C
DSPDRPWNPPTFSPALLVVTEGDNATFTCSFSNTSESFVLNWYRMSPSNQTDKLCAFPEDRSQPGQDCRFRVTQLPNGRDFHMSVVRARRNDSGTYLCGAISLAPKAQIKESLRAELRVTER

SEQ ID NO: 470 - protein, 122 aa, Artificial Sequence
  PD-1 v201 (6-127) L60C
DSPDRPWNPPTFSPALLVVTEGDNATFTCSFSNTSESFHVIWHRESPSGQTDTLCAFPEDRSQPGQDCRFRVTQLPNGRDFHMSVVRARRNDSGTYVCGVISLAPKIQIKESLRAELRVTER

SEQ ID NO: 471 - protein, 7 aa, Artificial Sequence
  Linker
GSGGGGS

SEQ ID NO: 472 - protein, 5 aa, Artificial Sequence
  4GS Linker
GGGGS

SEQ ID NO: 473 - protein, 15 aa, Artificial Sequence
  3x G4S Linker
GGGGSGGGGSGGGGS

SEQ ID NO: 474 - protein, 10 aa, Artificial Sequence
  2x G4S Linker
GGGGSGGGGS

SEQ ID NO: 475 - protein, 13 aa, Artificial Sequence
  Linker
GGGGSGGGGSAAA

SEQ ID NO: 476 - protein, 231 aa, Artificial Sequence
  Stack Fc (homodimeric)
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 477 - protein, 498 aa, Artificial Sequence
  ICOSL/PD-1 Stack 1
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVGGGGSGGGGSGGGGSDSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 478 - protein, 498 aa, Artificial Sequence
  ICOSL/PD-1 Stack 2
DSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERGGGGSGGGGSGGGGSDTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 479 - protein, 498 aa, Artificial Sequence
  ICOSL/PD-1 Stack 3
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVGGGGSGGGGSGGGGSDSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 480 - protein, 498 aa, Artificial Sequence
  ICOSL/PD-1 Stack 4
DSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERGGGGSGGGGSGGGGSDTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 481 - protein, 498 aa, Artificial Sequence
  ICOSL/PD-1 Stack 5
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVGGGGSGGGGSGGGGSDSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 482 - protein, 498 aa, Artificial Sequence
  ICOSL/PD-1 Stack 6
DSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERGGGGSGGGGSGGGGSDTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 483 - protein, 498 aa, Artificial Sequence
  ICOSL/PD-1 Stack 7
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVGGGGSGGGGSGGGGSDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 484 - protein, 498 aa, Artificial Sequence
  ICOSL/PD-1 Stack 8
DSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERGGGGSGGGGSGGGGSDTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 485 - protein, 498 aa, Artificial Sequence
  ICOSL/PD-1 Stack 9
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVGGGGSGGGGSGGGGSDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 486 - protein, 498 aa, Artificial Sequence
  ICOSL/PD-1 Stack 10
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVGGGGSGGGGSGGGGSDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 487 - protein, 498 aa, Artificial Sequence
  ICOSL/PD-1 Stack 11
DSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERGGGGSGGGGSGGGGSDTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 488 - protein, 361 aa, Artificial Sequence
  WT PD-1-(6-127) Fc
DSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 489 - protein, 361 aa, Artificial Sequence
  PD-1-v201 Fc
DSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 490 - protein, 150 aa, Artificial Sequence
  PD-1 v142 (1-150)
PGWFLDSPDRPWNPPTFSPALLVVTEGDNATFTCSFSSTSESFVLNWYRMSPSNQTDKMAAFPEDRSQPGLDCRFRVTQLPNGRDFHMSVVRARRNDSGTYLCGAITLAPKVQIEESLQVELRVTERRAEVPTAHPSPSPRPAGQFQTLV

SEQ ID NO: 491 - protein, 150 aa, Artificial Sequence
  PD-1 v143 (1-150)
PGWFLDSPDRPWNPPTFSPALLVVTEGDNATFTCSFSNTSESFVLNWYRVSPSNQTDKMAAFPEDRSQPGQDCRFRVTQLPNGRDFHMSVVRARRNDSGTYLCGAISLAPKVQIKESLQVELRVTERRAEVPTAHPSPSPRPAGQFQTLV

SEQ ID NO: 492 - protein, 150 aa, Artificial Sequence
  PD-1 v144 (1-150)
PGWFLDSPDRPWNPPTFSPALLVVTEGDNATFTCSFSNTSESFVLNWYRMSPSNQTDKLAAFPEDRSQPGQDCRFRVTQLSNGRDYHMSVVSARRNDSGTYLCGAITLAPKVQIEESLRVELRVTERRAEVPTAHPSPSPRPAGQFQTLV

SEQ ID NO: 493 - protein, 150 aa, Artificial Sequence
  PD-1 v145 (1-150)
PGWFLDSPDRPWNPPTFSPALLVVTEGDNATFTCSFSNTSESFVLNWYRMSPSNQTDKLAAFPEDRSQPGQDRRFRVTQLPNGQDYHMSVVRARRNDSGTYLCGAITLAPKVQIDESLRVELRVTERRAEVPTAHPSPSPRPAGQFQTLV

SEQ ID NO: 494 - protein, 150 aa, Artificial Sequence
  PD-1 v146 (1-150)
PGWFLDSPDRPGNPPTFSPALLVVTEGDNATFTCSFSNTSESFVLNWYRTSPNNQTDKLAAFPEDRRQPSQDRRFRVTQLPNGRDFHMSVVRARRNDSGTYLCVAISLAPKVQIEESLWAELRVTERRAEVPTAHPSPSPRPAGQFQTLV

SEQ ID NO: 495 - protein, 150 aa, Artificial Sequence
  PD-1 v147 (1-150)
PGWFLDSPDRPWNPPTFSPALLVVTEGDNAIFTCSYSNTSESYVLNWYRMSPSNQTDKLAAFPEDRNQPSQDRRFRVTQLPNGRDFHMSMVRARRNDSGTYLCGAISLAPKVQIKESLWAELRVTERRAEVPTAHPSPSPRPAGQFQTLV

SEQ ID NO: 496 - protein, 150 aa, Artificial Sequence
  PD-1 v148 (1-150)
PGWFLDSPDRPWNPPTFSPALLVVTEGDNATFTCSFSNTSESFVLNWYRMSPSNQTDKLAAFPEDRSQPGQDCRFSVTQLPNGRDFHMSVVRARRNDSGTYLCGAITLAPNVQINESLRVELRVTERRAEVPTAHPSPSPRPAGQFQTLV

SEQ ID NO: 497 - protein, 150 aa, Artificial Sequence
  PD-1 v149 (1-150)
PGWFLDSPDRPWNPPTFSPALLVVTEGDNATFTCSFSNTSESFVLNWYRMSPSNQTDKLAAFPEDRSQPGQDCRFRVTQLPNGRDYHMSVVRARRNDSGTYLCGAISLAPKVQIKESLWVELRVTERRAEVPTAHPSPSPRPAGQFQTLV

SEQ ID NO: 498 - protein, 150 aa, Artificial Sequence
  PD-1 v150 (1-150)
PGWFLDSPDRPWSPPTFSPALLVVTEGDNATFTCSFSNTSESFVLNWYRISPSNQTDKLAAFPEDRSQPGQDCRFSVTQLPNGRDFHMSVVRARRNDSGTYLCGAITLAPKVQINESLWVELRVTERRAEVPTAHPSPSPRPAGQFQTLV

SEQ ID NO: 499 - protein, 150 aa, Artificial Sequence
  PD-1 v151 (1-150)
PGWFLDSPDRPWNHPSFSPALLVVTEGDNATFTCSFSNTSESFVLNWYRLSPSNQTDKLAAFPEDRSQPGQDRRFRVTQLPNGQDYHMSVVRARRNDSGTYLCGAITLAPKVQIEESLRVELRVTERRAEVPTAHPSPSPRPAGQFQTLV

SEQ ID NO: 500 - protein, 150 aa, Artificial Sequence
  PD-1 v152 (1-150)
PGWFLDSPDRPWNPPTLSPALLVVAEGDNATFTCSFSNTSESFVLNWYRMSPSNQTDKMAAFPKDRSQPGQDCRFRVTQLPNGRDYHMSVVRAQRNDSGTYLCGAITLAPKVQINESLWVELRVTERRAEVPTAHPSPSPRPAGQFQTLV

SEQ ID NO: 501 - protein, 150 aa, Artificial Sequence
  PD-1 v153 (1-150)
PGWFLDSPDRPWNPPTFSPALLVVTEGDNATFTCSFSNTSESFVLNWYRMSPSNQTDKLAAFPEDRSQPGRDCRFRVTQLPNGRDYHMSVVRARRNDSGTYLCGAISLAPKVQIEESLQVELRVTERRAEVPTAHPSPSPRPAGQFQTLV

SEQ ID NO: 502 - protein, 150 aa, Artificial Sequence
  PD-1 v154 (1-150)
PGWFLDSPDRPWNPPTFSPALLVVTEGDNATFTCSFSNTSESFVLNWYRMSPSNQTDKLAAFPEDRSQPGQDCRFSVTQLPNGRDFHMSVVRARRNDSGTYLCGAITLAPKVQINESLWVELRVTERRAEVPTAHPSPSPRPAGQFQTLV

SEQ ID NO: 503 - protein, 150 aa, Artificial Sequence
  PD-1 v155 (1-150)
PGWFLDSPDRPWNPPTFSPALLVVTEGDNATFTCSFSNTSESFVLNWYRISPSNQTDKLAAFPEDRSQPGQDCRFRVTQLPNGRDFHMSVVRARRNDSGTYLCGAISLAPKVQIDESLRVELRVTERRAEVPTAHPSPSPRPAGQFQTLV

SEQ ID NO: 504 - protein, 150 aa, Artificial Sequence
  PD-1 v156 (1-150)
PGWFLDSPDRPWNPPTFSPALLVVTEGDNATFTCSFSNTSESFVLNWYRVSPSNQTDKLAAFPEDRSQPGQDCRFRVTQLSNGRDYHMSVVSARRNDSGTYLCGAITLAPKVQIEESLRVELRVTERRAEVPTAHPSPSPRPAGQFQTLV

SEQ ID NO: 505 - protein, 150 aa, Artificial Sequence
  PD-1 v157 (1-150)
PGWFLDSPDRPWNPPTFSPALLVVTEGDNATFTCSFSNTSESFVLNWYRISPSNQTDKLAAFPEDRNQPRQDCRFRVTQLPNGRDFHMSVVRARRNDSGTYLCGAISLAPTVQIKESLWVELRVTERRAEVPTAHPSPSPRPAGQFQTLV

SEQ ID NO: 506 - protein, 150 aa, Artificial Sequence
  PD-1 v158 (1-150)
PGWFLDSPDRPWNHPSFSPALLVVTEGDNATFTCSFSNTSESFVLNWYRLSPSNQTDKLAAFPEDRSQPGQDCRFRVTQQPNGRDFHMSVVRARRNDSGTYLCGAISLAPMAQIKESLQVELRVTERRAEVPTAHPSPSPRPAGQFQTLV

SEQ ID NO: 507 - protein, 150 aa, Artificial Sequence
  PD-1 v159 (1-150)
PGWFLDSPDRPWNPPTFSPALLVVTEGDNAIFTCSYSNTSESFVLNWYRMSPSNQTDKLAAFPKDRSQPGQDCRFRVTQLPNGRDFHMSVVRARRNDSGTYLCGAISLAPKVQIEESLQVELRVTERRAEVPTAHPSPSPRPAGQFQTLV

SEQ ID NO: 508 - protein, 150 aa, Artificial Sequence
  PD-1 v160 (1-150)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAITLAPKVQIKESLWVELRVTERRAEVPTAHPSPSPRPAGQFQTLV

SEQ ID NO: 509 - protein, 150 aa, Artificial Sequence
  PD-1 v161 (1-150)
PGWFLDSPDRPWNPPTFSPALLVVTEGDNATFTCSFSNTSESFVLNWYRMSPSNQSDKLAAFPEDRSQPGQDCRFRVTQLPNGRDFHMSVVRARRNDSGTYLCGAISLAPKVQIEESLRVELRVTERRAEVPTAHPSPSPRPAGQFQTLV

SEQ ID NO: 510 - protein, 150 aa, Artificial Sequence
  PD-1 v162 (1-150)
PGWFLDSPDRPWNPPTFSPALLVVTEGDNATFTCSFSNTSESFVLNWYRMSPSNQSDKLAAFPEDRSQPGQDCRFRVTQLPNGRDFHMSVVRARRNDSGTYLCGAISLAPKVQIKESLWAELRVTERRAEVPTAHPSPSPRPAGQFQTLV

SEQ ID NO: 511 - protein, 150 aa, Artificial Sequence
  PD-1 v163 (1-150)
PGWFLDSPDRPWNPPTFSPALLVVTEGDNATFTCSFSNTSESFVLNWYRMSPSNQSDKLAAFPEDRSQPGQDCRFRVTQLPNGRDFHMSVVRARRNDSGTYLCGAISLAPKAQIKESLRAELRVTERRAEVPTAHPSPSPRPAGQFQTLV

SEQ ID NO: 512 - protein, 150 aa, Artificial Sequence
  PD-1 v164 (1-150)
PGWFLDSPDRPWNPPTFSPALLVVTEGDNATFTCSFSNTSESFVLIWNRMSPSNQTYKLAAFPEDRCQPGQDCRFRVTQLPNGRDFHMSLVRARRNDSGTYLCGAISLAPKVQIKESLRAELRVTERRAEVPTAHPSPSPRPAGQFQTLV

SEQ ID NO: 513 - protein, 150 aa, Artificial Sequence
  PD-1 v165 (1-150)
PGWFLDSPDRPWNPPTFSPALLVVTEGDNATFTCSFSNTSESFVLNWYRMSPSNQSDKLAAFPEDRSQPGQDCRFRVTQLPNGRDFHMSVVRARRNDSGTYLCGAISLAPKVQIKESLPAELRVTERRAEVPTAHPSPSPRPAGQFQTLV

SEQ ID NO: 514 - protein, 150 aa, Artificial Sequence
  PD-1 v166 (1-150)
PGWFLDSPDRPWNHPTISPALLVVTEGDNATFTCSFSNTSESFMLNWYRMSPSNQTDKLAAFPEDRSQPGQDCRFRVTQLPNGRDFHMSVVRARRNDSGTYLCGAISLAPKVQIEESLRVELRVTERRAEVPTAHPSPSPRPAGQFQTLV

SEQ ID NO: 515 - protein, 150 aa, Artificial Sequence
  PD-1 v167 (1-150)
PGWFLDSPDRPWNPPTFSPALLVVTEGDNATFTCSFSSTSESFVLNWYRMSPSNQSDKLAAFPEDRSQPGQDCRFRVTQLPNGRDFHMSVVRARRNDSGTYLCGAISLAPKVQIEESLRVELRVTERRAEVPTAHPSPSPRPAGQFQTLV

SEQ ID NO: 516 - protein, 150 aa, Artificial Sequence
  PD-1 v168 (1-150)
PGWFLDSPDRPWNPPTFSPALLVVTEGDNATFTCSFSNTSEGFVLNWYRLSPSNQTDKLAAFPEDRSQSGQDCRFRVTQLPNGRDYHMSVVRARRNDSGTYLCGAISLAPKVQIEESLRAELRVTERRAEVPTAHPSPSPRPAGQFQTLV

SEQ ID NO: 517 - protein, 150 aa, Artificial Sequence
  PD-1 v169 (1-150)
PGWFLDSPDRPWNHPTFSPALLVVTEGDNATFTCSFSNTSESFVLNWYRMSPSNQSDKLAAFPEDRSQPGQDCRFRVTQLPNGRDFHMSVVRARRNDSGTYLCGAISLAPKVQIEESLRVELRVTERRAEVPTAHPSPSPRPAGQFQTLV

SEQ ID NO: 518 - protein, 150 aa, Artificial Sequence
  PD-1 v170 (1-150)
PGWFLDSPDRPWSPPTFSPALLVVTEGDNATFTCSFSNTSESFVLNWYRMSPSNQTDKLAAFPEDRNQPCQDCRFRVTQLPNGRDYHMNVDRARRNDSGTYLCGAISLAPKVQIKESLLVELRVTERRAEVPTAHPSPSPRPAGQFQTLV

SEQ ID NO: 519 - protein, 150 aa, Artificial Sequence
  PD-1 v171 (1-150)
PGWFLDSPDRPGNPPTFSPALLVVTEGDNATFTCSFSNTSESFVLNWYRMSPSNQTDKLAAFPEDRNQPGRDCRFRVTQLPNGRDYHMSVVRARRNDSGTYLCGAISLAPMVQIQESLWAELRVTERRAEVPTAHPSPSPRPAGQFQTLV

SEQ ID NO: 520 - protein, 150 aa, Artificial Sequence
  PD-1 v172 (1-150)
PGWFLDSPDRPWNPPTFSPALLVVTEGDNATFTCSFSNTSESFVLNWYRMSPSNQTDKLAAFPEDRNQPGQDRRFRVTQLPNGRDFHMSVDRARRNDSGTYLCGAITLAPMVQIQESLWAELRVTERRAEVPTAHPSPSPRPAGQFQTLV

SEQ ID NO: 521 - protein, 150 aa, Artificial Sequence
  PD-1 v173 (1-150)
PGWFLDSPDRPWSPPTFSPALLVVTEGDNATFTCSFSNTSESFVLNWYRISPSNQTDKLAAFPEDRSQPGQDCRFSVTQLPNGRDFHMSVVRARRNDSGTYLCGAITLAPMVQIQESLWAELRVTERRAEVPTAHPSPSPRPAGQFQTLV

SEQ ID NO: 522 - protein, 150 aa, Artificial Sequence
  PD-1 v174 (1-150)
PGWFLDSPDRPWNPPTFSPALLVVTEGDNATFICSFSNTSESFVLNWYRMSPSNQTDKLAAFPEDRNQPSQDCRFRVTQLPNGRDFHMSVVRARRNDSGTYLCGAITLAPNVQIEESLWAELRVTERRAEVPTAHPSPSPRPAGQFQTLV

SEQ ID NO: 523 - protein, 150 aa, Artificial Sequence
  PD-1 v175 (1-150)
PGWFLDSPDRPWNPPTFSPALLVVTEGDNATFTCSFSNTSESFVLNWYRMSPSNQTDKLAAFPEDRSQLGQDCRFRVTQLPNGRDYHMSMVRARRNDSGIYLCGAITLAPNVQINESLRVELRVTERRAEVPTAHPSPSPRPAGQFQTLV

SEQ ID NO: 524 - protein, 150 aa, Artificial Sequence
  PD-1 v176 (1-150)
PGWFLDSPDRPWNPPTLSPALLVVAEGDNATFTCSFSNTSESFVLNWYRMSPSNQTDKLAAFPEDRSQLGQDCRFRVTQLPNGRDYHMSMVRARRNDSGIYLCGAITLAPNVQINESLRVELRVTERRAEVPTAHPSPSPRPAGQFQTLV

SEQ ID NO: 525 - protein, 150 aa, Artificial Sequence
  PD-1 v177 (1-150)
PGWFLDSPDRPWNPPTFSPALLVVTEGDNATFICSFSNTSESFVLNWYRISPSNQTDKLAAFPEDRSQPGQDCRFSVTQLPNGRDYHMSVVRARRNDSGTYLCGAITLAPKVQINESLWVELRVTERRAEVPTAHPSPSPRPAGQFQTLV

SEQ ID NO: 526 - protein, 150 aa, Artificial Sequence
  PD-1 v178 (1-150)
PGWFLDSPDRPWSPPTFSPALLVVTEGDNATFTCSFSNTSESFVLNWYRMSPSNQTDKLAAFPEDRNQPGQDRRFRVTQLPNGRDYHMSVVRARRNDSGTYLCGAITLAPKVRIEESLRVELRVTERRAEVPTAHPSPSPRPAGQFQTLV

SEQ ID NO: 527 - protein, 150 aa, Artificial Sequence
  PD-1 v179 (1-150)
PGWFLDSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTERRAEVPTAHPSPSPRPAGQFQTLV

SEQ ID NO: 528 - protein, 150 aa, Artificial Sequence
  PD-1 v180 (1-150)
PGWFLDSPDRPWNPPTLSPALLVVAEGDNATFTCSFSNTSESFVLNWYRMSPSNQTDKLAAFPEDRNQPGQDRRFRVTQLPNGQDYHMSVVRVRRNDSGTYLCGAISLAPKVQIEESLWAELRVTERRAEVPTAHPSPSPRPAGQFQTLV

SEQ ID NO: 529 - protein, 150 aa, Artificial Sequence
  PD-1 v181 (1-150)
PGWFLDSPDRPWNPPTFSPALLVVTEGDNATFTCSFSNTSESFVLNWYRMSPSNQSDKLAAFPEDRSQPGQDCRFRVTQLPNGRDFHMSVVRARRNDSGTYLCGAISLAPKVQIEESLRAELRVTERRAEVPTAHPSPSPRPAGQFQTLV

SEQ ID NO: 530 - protein, 150 aa, Artificial Sequence
  PD-1 v182 (1-150)
PGWFLDSPDRPWNPPTFSPALLVVTEGDNATFTCSFSNTSESFVLNWYRMSPSNQTDKLAAFPEDRSQLGQDCRFRVTQLPNGRDFHMSVDRARRNDSGTYLCGAISLAPKVQINESLWVELRVTERRAEVPTAHPSPSPRPAGQFQTLV

SEQ ID NO: 531 - protein, 150 aa, Artificial Sequence
  PD-1 v183 (1-150)
PGWFLDSPDRPWSPPTFSPALLVVTEGDNATFTCSFSNTSDSFVLNWYRISPSNQTDKLAAFPEDRSQPVQNCRFRVTQLPNGRDYHMSVVRAQRNDSGTYLCGAISLAPKVQIKESLLVELRVTERRAEVPTAHPSPSPRPAGQFQTLV

SEQ ID NO: 532 - protein, 150 aa, Artificial Sequence
  PD-1 v184 (1-150)
PGWFLDSPDRPWNPPTFSPALLVVTEGDNATFTCSFSNTSESFVLNWYRISPSNQTDKLAAFPEDRSQLGQDCRFRVTQLPNGRDYHMSMVRARRNDSGIYLCGAITLAPNVQINESLRVELRVTERRAEVPTAHPSPSPRPAGQFQTLV

SEQ ID NO: 533 - protein, 150 aa, Artificial Sequence
  PD-1 v185 (1-150)
PGWFLDSPDRPWNPPTFSPALLVVTEGDNATFTCSFSNTSESFVLNWYRISPSNQTDKLAAFPEDRSQPGQDRRFRVTQLPNGRDFHMSVVRARRNDSGTYLCGAITLAPNVQINESLRVELRVTERRAEVPTAHPSPSPRPAGQFQTLV

SEQ ID NO: 534 - protein, 150 aa, Artificial Sequence
  PD-1 v186 (1-150)
PGWFLDSPDRPWNPPTFSPALLVVTEGDNATFTCSFSNTSESFVLNWYRMSPSNQTDKLAAFPEDRSQPGQDCRFRVTQLPNGRDYHMSVVRARRNDSGTYLCGAISLAPKVQINESLWAELRVTERRAEVPTAHPSPSPRPAGQFQTLV

SEQ ID NO: 535 - protein, 150 aa, Artificial Sequence
  PD-1 v187 (1-150)
PGWFLDSPDRPWNPPTFSPALLVVTEGDNATFTCSFSNTSESFVLNWYRISPSNQTDKLAAFPEDRNQPGQDRRFRVTQLPNGRDYHMSVVRARLNDSGTYLCGAITLAPKVQINESLWAELRVTERRAEVPTAHPSPSPRPAGQFQTLV

SEQ ID NO: 536 - protein, 150 aa, Artificial Sequence
  PD-1 v188 (1-150)
PGWFLDSPDRPWNPPTFSPALLVVTEGDNATFTCSFSNTSESFVLNWYRLSPSNQTDKLAAFPEDRSRSGQDCRFRVTQLPNGRDYHMSVVRARRNDSGTYLCGAITLAPKVQINESLWAELRVTERRAEVPTAHPSPSPRPAGQFQTLV

SEQ ID NO: 537 - protein, 150 aa, Artificial Sequence
  PD-1 v189 (1-150)
PGWFLDSPDRPWNPPTFSPALLVVTEGDNATFTCSFSTTSESFVLNWYRMSPSNQTDKLAAFPEDRSQPGQDCRFRVTQLPNGRDFHMSVVRARRNDSGTYLCGAISLAPKVQINESLLVELRVTERRAEVPTAHPSPSPRPAGQFQTLV

SEQ ID NO: 538 - protein, 150 aa, Artificial Sequence
  PD-1 v190 (1-150)
PGWFLDSPDRPWNPPTFSPALLVVTEGDNATFTCSFSNTSESFVLNWYRMSPSNQTDKLAAFPEDRNQPGHDCRFRVTQLPNGRDYHMSVVRARLNDSGTYLCGAITLAPKVQINESLWAELRVTERRAEVPTAHPSPSPRPAGQFQTLV

SEQ ID NO: 539 - protein, 150 aa, Artificial Sequence
  PD-1 v191 (1-150)
PGWFLDSPDRPWNPPTFSPTLLVVTEGENATFTCSLSNTSESFVLNWYRISPSNQTDKLAAFPEDRSRSGQDCRFRVTQLPNGRDYHMSVVRARRNDSGTYLCGAISLAPKVQIKESLLVELRVTERRAEVPTAHPSPSPRPAGQFQTLV

SEQ ID NO: 540 - protein, 150 aa, Artificial Sequence
  PD-1 v192 (1-150)
PGWFLDSPDRPWNPPTFSPALLVVTEGDNATFTCSFSNTSESFVLNWYRISPSNQTDKLAAFPEDRNQPGQDRRFRVTQLPNGRDYHMSVVRARLNDSGTYLCGAISLAPKVWIKESLLVELRVTERRAEVPTAHPSPSPRPAGQFQTLV

SEQ ID NO: 541 - protein, 150 aa, Artificial Sequence
  PD-1 v193 (1-150)
PGWFLDSPDRPWNPPTFSPALLVVTEGDNATFTCSFSNTSESFVLNWYRMSPSNQTDKMAAFPEDRNQPGLDRRFRVTQLPNGRDFHMSVVRARLNDSGTYLCGAITLAPKVQINESLWAELRVTERRAEVPTAHPSPSPRPAGQFQTLV

SEQ ID NO: 542 - protein, 150 aa, Artificial Sequence
  PD-1 v194 (1-150)
PGWFLDSPDRPWNPPTFSPALLVVTEGDNATFTCSFSNTSESFVLNWYRMSLNNQTDKLAAFPEDRSQPGQDSRFRVTQLPNGRDFHMSVVRARRNDSGTYLCGAISLAPKVQIKDSLWAELRVTERRAEVPTAHPSPSPRPAGQFQTLV

SEQ ID NO: 543 - protein, 150 aa, Artificial Sequence
  PD-1 v195 (1-150)
PGWFLDSPDRPWNPPTFSPALLVVTEGDNATFTCSFSNTSESFVLNWYRMSPSNQTDKLAAFPEDRSQPGRDRRFRVTQLPNGRDFHMSVVRARRNDSGTYLCGAISLAPKVQINESLLVELRVTERRAEVPTAHPSPSPRPAGQFQTLV

SEQ ID NO: 544 - protein, 150 aa, Artificial Sequence
  PD-1 v196 (1-150)
PGWFLDSPDRPLNPPTFSPTLLVVTEGDDATFTCSFPNTSESFVLNWYRMSPSNQTDKMAAFPEDRSRSGQDCRFRVTQLPNGRDYHMSVVRARRNDSGTYLCGAISLAPKVQIKESLLVELRVTERRAEVPTAHPSPSPRPAGQFQTLV

SEQ ID NO: 545 - protein, 150 aa, Artificial Sequence
  PD-1 v197 (1-150)
PGWFLDSPDRPWNPPTFSPALLVVTEGDNATFTCSFSNTSESFVLIWFRMSPSNQTVKLAAFPEDRSQLGQDCRFRVTQLPNGRDFHMSVVRARRNDSGTYLCGAISLAPKVQINESLWAELRVTERRAEVPTAHPSPSPRPAGQFQTLV

SEQ ID NO: 546 - protein, 150 aa, Artificial Sequence
  PD-1 v198 (1-150)
PGWFLDSPDRPWNPPTFSPALLVVTEGDNATFTCSFSNTSESFVLNWYRISPSNQTDKLAAFPEDRNQPGQDRRFRVTQLPNGRDYHMSVVRARLNDSGTYLCGAITLAPKVQIQESLQVELRVTERRAEVPTAHPSPSPRPAGQFQTLV

SEQ ID NO: 547 - protein, 150 aa, Artificial Sequence
  PD-1 v199 (1-150)
PGWFLDSPDRPWNPPTFSPALLVVTEGDNATFTCSFSNTSESFVLNWYRMSPSDQTDKLAAFPEDRSQHGQDRRFRVTQLPNGRDYHMSVVRARLNDSGTYLCGAITLAPKVQINESLWAELRVTERRAEVPTAHPSPSPRPAGQFQTLV

SEQ ID NO: 548 - protein, 150 aa, Artificial Sequence
  PD-1 v200 (1-150)
PGWFLDSPDRPWNPPTFSPALLVVTEGDNATFTCSFSNTSESFVLNWYRMSPSNQSDKLAAFPEDRSQPGKDCRFRVTQLPNGRDYHMSVVRARLNDSGTYLCGAITLAPKVQINESLWAELRVTERRAEVPTAHPSPSPRPAGQFQTLV

SEQ ID NO: 549 - protein, 111 aa, Artificial Sequence
  PD-1 v142 (15-125)
PTFSPALLVVTEGDNATFTCSFSSTSESFVLNWYRMSPSNQTDKMAAFPEDRSQPGLDCRFRVTQLPNGRDFHMSVVRARRNDSGTYLCGAITLAPKVQIEESLQVELRVT

SEQ ID NO: 550 - protein, 111 aa, Artificial Sequence
  PD-1 v143 (15-125)
PTFSPALLVVTEGDNATFTCSFSNTSESFVLNWYRVSPSNQTDKMAAFPEDRSQPGQDCRFRVTQLPNGRDFHMSVVRARRNDSGTYLCGAISLAPKVQIKESLQVELRVT

SEQ ID NO: 551 - protein, 111 aa, Artificial Sequence
  PD-1 v144 (15-125)
PTFSPALLVVTEGDNATFTCSFSNTSESFVLNWYRMSPSNQTDKLAAFPEDRSQPGQDCRFRVTQLSNGRDYHMSVVSARRNDSGTYLCGAITLAPKVQIEESLRVELRVT

SEQ ID NO: 552 - protein, 111 aa, Artificial Sequence
  PD-1 v145 (15-125)
PTFSPALLVVTEGDNATFTCSFSNTSESFVLNWYRMSPSNQTDKLAAFPEDRSQPGQDRRFRVTQLPNGQDYHMSVVRARRNDSGTYLCGAITLAPKVQIDESLRVELRVT

SEQ ID NO: 553 - protein, 111 aa, Artificial Sequence
  PD-1 v146 (15-125)
PTFSPALLVVTEGDNATFTCSFSNTSESFVLNWYRTSPNNQTDKLAAFPEDRRQPSQDRRFRVTQLPNGRDFHMSVVRARRNDSGTYLCVAISLAPKVQIEESLWAELRVT

SEQ ID NO: 554 - protein, 111 aa, Artificial Sequence
  PD-1 v147 (15-125)
PTFSPALLVVTEGDNAIFTCSYSNTSESYVLNWYRMSPSNQTDKLAAFPEDRNQPSQDRRFRVTQLPNGRDFHMSMVRARRNDSGTYLCGAISLAPKVQIKESLWAELRVT

SEQ ID NO: 555 - protein, 111 aa, Artificial Sequence
  PD-1 v148 (15-125)
PTFSPALLVVTEGDNATFTCSFSNTSESFVLNWYRMSPSNQTDKLAAFPEDRSQPGQDCRFSVTQLPNGRDFHMSVVRARRNDSGTYLCGAITLAPNVQINESLRVELRVT

SEQ ID NO: 556 - protein, 111 aa, Artificial Sequence
  PD-1 v149 (15-125)
PTFSPALLVVTEGDNATFTCSFSNTSESFVLNWYRMSPSNQTDKLAAFPEDRSQPGQDCRFRVTQLPNGRDYHMSVVRARRNDSGTYLCGAISLAPKVQIKESLWVELRVT

SEQ ID NO: 557 - protein, 111 aa, Artificial Sequence
  PD-1 v150 (15-125)
PTFSPALLVVTEGDNATFTCSFSNTSESFVLNWYRISPSNQTDKLAAFPEDRSQPGQDCRFSVTQLPNGRDFHMSVVRARRNDSGTYLCGAITLAPKVQINESLWVELRVT

SEQ ID NO: 558 - protein, 111 aa, Artificial Sequence
  PD-1 v151 (15-125)
PSFSPALLVVTEGDNATFTCSFSNTSESFVLNWYRLSPSNQTDKLAAFPEDRSQPGQDRRFRVTQLPNGQDYHMSVVRARRNDSGTYLCGAITLAPKVQIEESLRVELRVT

SEQ ID NO: 559 - protein, 111 aa, Artificial Sequence
  PD-1 v152 (15-125)
PTLSPALLVVAEGDNATFTCSFSNTSESFVLNWYRMSPSNQTDKMAAFPKDRSQPGQDCRFRVTQLPNGRDYHMSVVRAQRNDSGTYLCGAITLAPKVQINESLWVELRVT

SEQ ID NO: 560 - protein, 111 aa, Artificial Sequence
  PD-1 v153 (15-125)
PTFSPALLVVTEGDNATFTCSFSNTSESFVLNWYRMSPSNQTDKLAAFPEDRSQPGRDCRFRVTQLPNGRDYHMSVVRARRNDSGTYLCGAISLAPKVQIEESLQVELRVT

SEQ ID NO: 561 - protein, 111 aa, Artificial Sequence
  PD-1 v154 (15-125)
PTFSPALLVVTEGDNATFTCSFSNTSESFVLNWYRMSPSNQTDKLAAFPEDRSQPGQDCRFSVTQLPNGRDFHMSVVRARRNDSGTYLCGAITLAPKVQINESLWVELRVT

SEQ ID NO: 562 - protein, 111 aa, Artificial Sequence
  PD-1 v155 (15-125)
PTFSPALLVVTEGDNATFTCSFSNTSESFVLNWYRISPSNQTDKLAAFPEDRSQPGQDCRFRVTQLPNGRDFHMSVVRARRNDSGTYLCGAISLAPKVQIDESLRVELRVT

SEQ ID NO: 563 - protein, 111 aa, Artificial Sequence
  PD-1 v156 (15-125)
PTFSPALLVVTEGDNATFTCSFSNTSESFVLNWYRVSPSNQTDKLAAFPEDRSQPGQDCRFRVTQLSNGRDYHMSVVSARRNDSGTYLCGAITLAPKVQIEESLRVELRVT

SEQ ID NO: 564 - protein, 111 aa, Artificial Sequence
  PD-1 v157 (15-125)
PTFSPALLVVTEGDNATFTCSFSNTSESFVLNWYRISPSNQTDKLAAFPEDRNQPRQDCRFRVTQLPNGRDFHMSVVRARRNDSGTYLCGAISLAPTVQIKESLWVELRVT

SEQ ID NO: 565 - protein, 111 aa, Artificial Sequence
  PD-1 v158 (15-125)
PSFSPALLVVTEGDNATFTCSFSNTSESFVLNWYRLSPSNQTDKLAAFPEDRSQPGQDCRFRVTQQPNGRDFHMSVVRARRNDSGTYLCGAISLAPMAQIKESLQVELRVT

SEQ ID NO: 566 - protein, 111 aa, Artificial Sequence
  PD-1 v159 (15-125)
PTFSPALLVVTEGDNAIFTCSYSNTSESFVLNWYRMSPSNQTDKLAAFPKDRSQPGQDCRFRVTQLPNGRDFHMSVVRARRNDSGTYLCGAISLAPKVQIEESLQVELRVT

SEQ ID NO: 567 - protein, 111 aa, Artificial Sequence
  PD-1 v160 (15-125)
PTFSPALLVVTEGDNATFTCSFSNTSESFVLNWYRMSPSNQTDKLAAFPEDRSQPGQDCRFRVTQLPNGRDFHMSVVRARRNDSGTYLCGAITLAPKVQIKESLWVELRVT

SEQ ID NO: 568 - protein, 111 aa, Artificial Sequence
  PD-1 v161, v169 (15-125)
PTFSPALLVVTEGDNATFTCSFSNTSESFVLNWYRMSPSNQSDKLAAFPEDRSQPGQDCRFRVTQLPNGRDFHMSVVRARRNDSGTYLCGAISLAPKVQIEESLRVELRVT

SEQ ID NO: 569 - protein, 111 aa, Artificial Sequence
  PD-1 v162 (15-125)
PTFSPALLVVTEGDNATFTCSFSNTSESFVLNWYRMSPSNQSDKLAAFPEDRSQPGQDCRFRVTQLPNGRDFHMSVVRARRNDSGTYLCGAISLAPKVQIKESLWAELRVT

SEQ ID NO: 570 - protein, 111 aa, Artificial Sequence
  PD-1 v163 (15-125)
PTFSPALLVVTEGDNATFTCSFSNTSESFVLNWYRMSPSNQSDKLAAFPEDRSQPGQDCRFRVTQLPNGRDFHMSVVRARRNDSGTYLCGAISLAPKAQIKESLRAELRVT

SEQ ID NO: 571 - protein, 111 aa, Artificial Sequence
  PD-1 v164 (15-125)
PTFSPALLVVTEGDNATFTCSFSNTSESFVLIWNRMSPSNQTYKLAAFPEDRCQPGQDCRFRVTQLPNGRDFHMSLVRARRNDSGTYLCGAISLAPKVQIKESLRAELRVT

SEQ ID NO: 572 - protein, 111 aa, Artificial Sequence
  PD-1 v165 (15-125)
PTFSPALLVVTEGDNATFTCSFSNTSESFVLNWYRMSPSNQSDKLAAFPEDRSQPGQDCRFRVTQLPNGRDFHMSVVRARRNDSGTYLCGAISLAPKVQIKESLPAELRVT

SEQ ID NO: 573 - protein, 111 aa, Artificial Sequence
  PD-1 v166 (15-125)
PTISPALLVVTEGDNATFTCSFSNTSESFMLNWYRMSPSNQTDKLAAFPEDRSQPGQDCRFRVTQLPNGRDFHMSVVRARRNDSGTYLCGAISLAPKVQIEESLRVELRVT

SEQ ID NO: 574 - protein, 111 aa, Artificial Sequence
  PD-1 v167 (15-125)
PTFSPALLVVTEGDNATFTCSFSSTSESFVLNWYRMSPSNQSDKLAAFPEDRSQPGQDCRFRVTQLPNGRDFHMSVVRARRNDSGTYLCGAISLAPKVQIEESLRVELRVT

SEQ ID NO: 575 - protein, 111 aa, Artificial Sequence
  PD-1 v168 (15-125)
PTFSPALLVVTEGDNATFTCSFSNTSEGFVLNWYRLSPSNQTDKLAAFPEDRSQSGQDCRFRVTQLPNGRDYHMSVVRARRNDSGTYLCGAISLAPKVQIEESLRAELRVT

SEQ ID NO: 576 - protein, 111 aa, Artificial Sequence
  PD-1 v170 (15-125)
PTFSPALLVVTEGDNATFTCSFSNTSESFVLNWYRMSPSNQTDKLAAFPEDRNQPCQDCRFRVTQLPNGRDYHMNVDRARRNDSGTYLCGAISLAPKVQIKESLLVELRVT

SEQ ID NO: 577 - protein, 111 aa, Artificial Sequence
  PD-1 v171 (15-125)
PTFSPALLVVTEGDNATFTCSFSNTSESFVLNWYRMSPSNQTDKLAAFPEDRNQPGRDCRFRVTQLPNGRDYHMSVVRARRNDSGTYLCGAISLAPMVQIQESLWAELRVT

SEQ ID NO: 578 - protein, 111 aa, Artificial Sequence
  PD-1 v172 (15-125)
PTFSPALLVVTEGDNATFTCSFSNTSESFVLNWYRMSPSNQTDKLAAFPEDRNQPGQDRRFRVTQLPNGRDFHMSVDRARRNDSGTYLCGAITLAPMVQIQESLWAELRVT

SEQ ID NO: 579 - protein, 111 aa, Artificial Sequence
  PD-1 v173 (15-125)
PTFSPALLVVTEGDNATFTCSFSNTSESFVLNWYRISPSNQTDKLAAFPEDRSQPGQDCRFSVTQLPNGRDFHMSVVRARRNDSGTYLCGAITLAPMVQIQESLWAELRVT

SEQ ID NO: 580 - protein, 111 aa, Artificial Sequence
  PD-1 v174 (15-125)
PTFSPALLVVTEGDNATFICSFSNTSESFVLNWYRMSPSNQTDKLAAFPEDRNQPSQDCRFRVTQLPNGRDFHMSVVRARRNDSGTYLCGAITLAPNVQIEESLWAELRVT

SEQ ID NO: 581 - protein, 111 aa, Artificial Sequence
  PD-1 v175 (15-125)
PTFSPALLVVTEGDNATFTCSFSNTSESFVLNWYRMSPSNQTDKLAAFPEDRSQLGQDCRFRVTQLPNGRDYHMSMVRARRNDSGIYLCGAITLAPNVQINESLRVELRVT

SEQ ID NO: 582 - protein, 111 aa, Artificial Sequence
  PD-1 v176 (15-125)
PTLSPALLVVAEGDNATFTCSFSNTSESFVLNWYRMSPSNQTDKLAAFPEDRSQLGQDCRFRVTQLPNGRDYHMSMVRARRNDSGIYLCGAITLAPNVQINESLRVELRVT

SEQ ID NO: 583 - protein, 111 aa, Artificial Sequence
  PD-1 v177 (15-125)
PTFSPALLVVTEGDNATFICSFSNTSESFVLNWYRISPSNQTDKLAAFPEDRSQPGQDCRFSVTQLPNGRDYHMSVVRARRNDSGTYLCGAITLAPKVQINESLWVELRVT

SEQ ID NO: 584 - protein, 111 aa, Artificial Sequence
  PD-1 v178 (15-125)
PTFSPALLVVTEGDNATFTCSFSNTSESFVLNWYRMSPSNQTDKLAAFPEDRNQPGQDRRFRVTQLPNGRDYHMSVVRARRNDSGTYLCGAITLAPKVRIEESLRVELRVT

SEQ ID NO: 585 - protein, 111 aa, Artificial Sequence
  PD-1 v179 (15-125)
PTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVT

SEQ ID NO: 586 - protein, 111 aa, Artificial Sequence
  PD-1 v180 (15-125)
PTLSPALLVVAEGDNATFTCSFSNTSESFVLNWYRMSPSNQTDKLAAFPEDRNQPGQDRRFRVTQLPNGQDYHMSVVRVRRNDSGTYLCGAISLAPKVQIEESLWAELRVT

SEQ ID NO: 587 - protein, 111 aa, Artificial Sequence
  PD-1 v181 (15-125)
PTFSPALLVVTEGDNATFTCSFSNTSESFVLNWYRMSPSNQSDKLAAFPEDRSQPGQDCRFRVTQLPNGRDFHMSVVRARRNDSGTYLCGAISLAPKVQIEESLRAELRVT

SEQ ID NO: 588 - protein, 111 aa, Artificial Sequence
  PD-1 v182 (15-125)
PTFSPALLVVTEGDNATFTCSFSNTSESFVLNWYRMSPSNQTDKLAAFPEDRSQLGQDCRFRVTQLPNGRDFHMSVDRARRNDSGTYLCGAISLAPKVQINESLWVELRVT

SEQ ID NO: 589 - protein, 111 aa, Artificial Sequence
  PD-1 v183 (15-125)
PTFSPALLVVTEGDNATFTCSFSNTSDSFVLNWYRISPSNQTDKLAAFPEDRSQPVQNCRFRVTQLPNGRDYHMSVVRAQRNDSGTYLCGAISLAPKVQIKESLLVELRVT

SEQ ID NO: 590 - protein, 111 aa, Artificial Sequence
  PD-1 v184 (15-125)
PTFSPALLVVTEGDNATFTCSFSNTSESFVLNWYRISPSNQTDKLAAFPEDRSQLGQDCRFRVTQLPNGRDYHMSMVRARRNDSGIYLCGAITLAPNVQINESLRVELRVT

SEQ ID NO: 591 - protein, 111 aa, Artificial Sequence
  PD-1 v185 (15-125)
PTFSPALLVVTEGDNATFTCSFSNTSESFVLNWYRISPSNQTDKLAAFPEDRSQPGQDRRFRVTQLPNGRDFHMSVVRARRNDSGTYLCGAITLAPNVQINESLRVELRVT

SEQ ID NO: 592 - protein, 111 aa, Artificial Sequence
  PD-1 v186 (15-125)
PTFSPALLVVTEGDNATFTCSFSNTSESFVLNWYRMSPSNQTDKLAAFPEDRSQPGQDCRFRVTQLPNGRDYHMSVVRARRNDSGTYLCGAISLAPKVQINESLWAELRVT

SEQ ID NO: 593 - protein, 111 aa, Artificial Sequence
  PD-1 v187 (15-125)
PTFSPALLVVTEGDNATFTCSFSNTSESFVLNWYRISPSNQTDKLAAFPEDRNQPGQDRRFRVTQLPNGRDYHMSVVRARLNDSGTYLCGAITLAPKVQINESLWAELRVT

SEQ ID NO: 594 - protein, 111 aa, Artificial Sequence
  PD-1 v188 (15-125)
PTFSPALLVVTEGDNATFTCSFSNTSESFVLNWYRLSPSNQTDKLAAFPEDRSRSGQDCRFRVTQLPNGRDYHMSVVRARRNDSGTYLCGAITLAPKVQINESLWAELRVT

SEQ ID NO: 595 - protein, 111 aa, Artificial Sequence
  PD-1 v189 (15-125)
PTFSPALLVVTEGDNATFTCSFSTTSESFVLNWYRMSPSNQTDKLAAFPEDRSQPGQDCRFRVTQLPNGRDFHMSVVRARRNDSGTYLCGAISLAPKVQINESLLVELRVT

SEQ ID NO: 596 - protein, 111 aa, Artificial Sequence
  PD-1 v190 (15-125)
PTFSPALLVVTEGDNATFTCSFSNTSESFVLNWYRMSPSNQTDKLAAFPEDRNQPGHDCRFRVTQLPNGRDYHMSVVRARLNDSGTYLCGAITLAPKVQINESLWAELRVT

SEQ ID NO: 597 - protein, 111 aa, Artificial Sequence
  PD-1 v191 (15-125)
PTFSPTLLVVTEGENATFTCSLSNTSESFVLNWYRISPSNQTDKLAAFPEDRSRSGQDCRFRVTQLPNGRDYHMSVVRARRNDSGTYLCGAISLAPKVQIKESLLVELRVT

SEQ ID NO: 598 - protein, 111 aa, Artificial Sequence
  PD-1 v192 (15-125)
PTFSPALLVVTEGDNATFTCSFSNTSESFVLNWYRISPSNQTDKLAAFPEDRNQPGQDRRFRVTQLPNGRDYHMSVVRARLNDSGTYLCGAISLAPKVWIKESLLVELRVT

SEQ ID NO: 599 - protein, 111 aa, Artificial Sequence
  PD-1 v193 (15-125)
PTFSPALLVVTEGDNATFTCSFSNTSESFVLNWYRMSPSNQTDKMAAFPEDRNQPGLDRRFRVTQLPNGRDFHMSVVRARLNDSGTYLCGAITLAPKVQINESLWAELRVT

SEQ ID NO: 600 - protein, 111 aa, Artificial Sequence
  PD-1 v194 (15-125)
PTFSPALLVVTEGDNATFTCSFSNTSESFVLNWYRMSLNNQTDKLAAFPEDRSQPGQDSRFRVTQLPNGRDFHMSVVRARRNDSGTYLCGAISLAPKVQIKDSLWAELRVT

SEQ ID NO: 601 - protein, 111 aa, Artificial Sequence
  PD-1 v195 (15-125)
PTFSPALLVVTEGDNATFTCSFSNTSESFVLNWYRMSPSNQTDKLAAFPEDRSQPGRDRRFRVTQLPNGRDFHMSVVRARRNDSGTYLCGAISLAPKVQINESLLVELRVT

SEQ ID NO: 602 - protein, 111 aa, Artificial Sequence
  PD-1 v196 (15-125)
PTFSPTLLVVTEGDDATFTCSFPNTSESFVLNWYRMSPSNQTDKMAAFPEDRSRSGQDCRFRVTQLPNGRDYHMSVVRARRNDSGTYLCGAISLAPKVQIKESLLVELRVT

SEQ ID NO: 603 - protein, 111 aa, Artificial Sequence
  PD-1 v197 (15-125)
PTFSPALLVVTEGDNATFTCSFSNTSESFVLIWFRMSPSNQTVKLAAFPEDRSQLGQDCRFRVTQLPNGRDFHMSVVRARRNDSGTYLCGAISLAPKVQINESLWAELRVT

SEQ ID NO: 604 - protein, 111 aa, Artificial Sequence
  PD-1 v198 (15-125)
PTFSPALLVVTEGDNATFTCSFSNTSESFVLNWYRISPSNQTDKLAAFPEDRNQPGQDRRFRVTQLPNGRDYHMSVVRARLNDSGTYLCGAITLAPKVQIQESLQVELRVT

SEQ ID NO: 605 - protein, 111 aa, Artificial Sequence
  PD-1 v199 (15-125)
PTFSPALLVVTEGDNATFTCSFSNTSESFVLNWYRMSPSDQTDKLAAFPEDRSQHGQDRRFRVTQLPNGRDYHMSVVRARLNDSGTYLCGAITLAPKVQINESLWAELRVT

SEQ ID NO: 606 - protein, 111 aa, Artificial Sequence
  PD-1 v200 (15-125)
PTFSPALLVVTEGDNATFTCSFSNTSESFVLNWYRMSPSNQSDKLAAFPEDRSQPGKDCRFRVTQLPNGRDYHMSVVRARLNDSGTYLCGAITLAPKVQINESLWAELRVT

SEQ ID NO: 607 - protein, 112 aa, Artificial Sequence
  CD3zeta intracellular signaling domain
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 608 - protein, 431 aa, Artificial Sequence
  antiCD19z chimeric antigen receptor
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAKPTTTPAPRPPTPAPTIASQPLSLRPEASRPAAGGAVHTRGLDFASDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 609 - protein, 21 aa, Artificial Sequence
  CD8-derived signal sequence
MALPVTALLLPLALLLHAARP

SEQ ID NO: 610 - protein, 23 aa, Artificial Sequence
  CD8-derived signal sequence
MALPVTALLLPLALLLHAARPGS

SEQ ID NO: 611 - protein, 245 aa, Artificial Sequence
  anti-CD19 scFv
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 612 - protein, 69 aa, Artificial Sequence
  CD8-derived hinge and transmembrane domain
AKPTTTPAPRPPTPAPTIASQPLSLRPEACRPAAGGAVHTRGLDFACDIYIWAPLAGTCGVLLLSLVIT

SEQ ID NO: 613 - protein, 42 aa, Artificial Sequence
  4-1BB-derived costimulatory domain
KRGRKKLLYIFKQPFMRPVQTTQEEDGCSCRFPEEEEGGCEL

SEQ ID NO: 614 - protein, 40 aa, Artificial Sequence
  CD28-derived costimulatory domain
SKRSRLLHSDYMNMTPRRPGPTRKHYQPYAPPRDFAAYRS

SEQ ID NO: 615 - protein, 41 aa, Artificial Sequence
  CD28-derived costimulatory domain
RSKRSRLLHSDYMNMTPRRPGPTRKHYQPYAPPRDFAAYRS

SEQ ID NO: 616 - protein, 44 aa, Artificial Sequence
  CD28-derived costimulatory domain
FWVRSKRSRLLHSDYMNMTPRRPGPTRKHYQPYAPPRDFAAYRS

SEQ ID NO: 617 - protein, 232 aa, Artificial Sequence
  Blue fluorescent protein
SELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 618 - protein, 472 aa, Artificial Sequence
  2nd Gen CAR
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 619 - protein, 497 aa, Artificial Sequence
  2nd Gen CAR
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGRSGEGRGSLLTCGDVEENPGPSR

SEQ ID NO: 620 - protein, 471 aa, Artificial Sequence
  2nd Gen CAR with CD28-derived costimulatory domain
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITMHRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 621 - protein, 248 aa, Artificial Sequence
  Anti-CD19 scFv
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAA

SEQ ID NO: 622 - DNA, 63 bp, Artificial Sequence
  antiCD19 chimeric antigen receptor
ggcagtggcgagggcagaggaagtctgctaacatgcggtgacgtcgaggagaatcctggccca

SEQ ID NO: 623 - DNA, 63 bp, Artificial Sequence; identical to SEQ ID NO: 622
  T2A

SEQ ID NO: 624 - protein, 21 aa, Artificial Sequence
  T2A
GSGEGRGSLLTCGDVEENPGP

SEQ ID NO: 625 - protein, 68 aa, Artificial Sequence
  CD8 hinge and transmembrane domain
KPTTTPAPRPPTPAPTIASQPLSLRPEACRPAAGGAVHTRGLDFACDIYIWAPLAGTCGVLLLSLVIT

SEQ ID NO: 626 - protein, 18 aa, Artificial Sequence
  T2A
EGRGSLLTCGDVEENPGP

SEQ ID NO: 627 - protein, 232 aa, Artificial Sequence
  Blue fluorescent protein
SRSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLWEAFTETLYPADGGLEGRNDMALKLVGGSHLIANIKTTYRSKKPAKNLKMPGVYYVDYRLERIKEANNETYVEQHEVAARYCDLPSKLGHKLN

SEQ ID NO: 628 - protein, 239 aa, Artificial Sequence
  eGFP
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 629 - protein, 431 aa, Artificial Sequence
  antiCD19 chimeric antigen receptor CAR-2
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEASRPAAGGAVHTRGLDFASDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 630 - protein, 707 aa, Artificial Sequence
  antiCD19 chimeric antigen receptor CAR-2
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEASRPAAGGAVHTRGLDFASDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPSRSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 631 - DNA, 8708 bp, Artificial Sequence
  anti-CD19 chimeric antigen receptor CAR-2
agcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacaataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcctcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgatcacgagactagcctcgagaagcttgatatcgaattcccacggggttggacgcgtaggaacagagaaacaggagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctctatataagcagagctcgtttagtgaaccgtcagatcgcctggagacgccatccacgctgttttgacttccatagaaggatcccctgcaggtaatacgactcactatagggtccactgccgccaccatggctctgcctgtgacagctctgctgctgcctctggccctgctgctccatgccgccagacccggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccacccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcgccaagcccaccacgacgccagcgccgcgaccaccaacaccggcgcccaccatcgcgtcgcagcccctgtccctgcgcccagaggcgagccggccagcggcggggggcgcagtgcacacgagggggctggacttcgccagtgatatctacatctgggcgcccctggccgggacttgtggggtccttctcctgtcactggttatcaccctttactgcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagtggcgagggcagaggaagtctgctaacatgcggtgacgtggaggagaatccgggcccctctagaagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattgagtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccagttccgcccattctccgccccatggctgactaattttttttatttatgcagaggccgaggccgcctcggcctctgagctattccagaagtagtgaggaggcttttttggaggcctaggcttttgcgtcgagacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgca

SEQ ID NO: 632 - protein, 428 aa, Artificial Sequence
  antiCD19 chimeric antigen receptor CAR-1
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 633 - protein, 706 aa, Artificial Sequence
  antiCD19 chimeric antigen receptor CAR-1
MALPVTALLLPLALLLHAARPGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGRSGEGRGSLLTCGDVEENPGPSRSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLWEAFTETLYPADGGLEGRNDMALKLVGGSHLIANIKTTYRSKKPAKNLKMPGVYYVDYRLERIKEANNETYVEQHEVAARYCDLPSKLGHKLN

SEQ ID NO: 634 - protein, 5 aa, Artificial Sequence
  EAAAK Linker
EAAAK

SEQ ID NO: 635 - protein, 15 aa, Artificial Sequence
  3x EAAAK Linker
EAAAKEAAAKEAAAK

SEQ ID NO: 636 - protein, 25 aa, Artificial Sequence
  5x EAAAK Linker
EAAAKEAAAKEAAAKEAAAKEAAAK

SEQ ID NO: 637 - protein, 400 aa, Artificial Sequence
  PAS
ASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPA

SEQ ID NO: 638 - protein, 22 aa, Artificial Sequence
  P2A
GSGATNFSLLKQAGDVEENPGP

SEQ ID NO: 639 - protein, 8 aa, Artificial Sequence
  Flag tag
DYKDDDDK

SEQ ID NO: 640 - protein, 6 aa, Artificial Sequence
  His tag
HHHHHH

SEQ ID NO: 641 - protein, 237 aa, Artificial Sequence
  eGFP
SKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 642 - protein, 237 aa, Artificial Sequence
  Green fluorescent protein
SKGEELFTGVVPILVELDGDVNGHKFSVSGEGEGDATYGKLTLKFICTTGKLPVPWPTLVTTFSYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 643 - protein, 17 aa, Artificial Sequence
  GS(G4S)3 linker
GSGGGGSGGGGSGGGGS

SEQ ID NO: 644 - protein, 27 aa, Artificial Sequence
  GS(G4S)5 linker
GSGGGGSGGGGSGGGGSGGGGSGGGGS

SEQ ID NO: 645 - protein, 122 aa, Artificial Sequence
  PD-1 wt (6-127) C73R
DSPDRPWNPPTFSPALLVVTEGDNATFTCSFSNTSESFVLNWYRMSPSNQTDKLAAFPEDRSQPGQDRRFRVTQLPNGRDFHMSVVRARRNDSGTYLCGAISLAPKAQIKESLRAELRVTER

SEQ ID NO: 646 - protein, 122 aa, Artificial Sequence
  PD-1 wt (6-127) C73S
DSPDRPWNPPTFSPALLVVTEGDNATFTCSFSNTSESFVLNWYRMSPSNQTDKLAAFPEDRSQPGQDSRFRVTQLPNGRDFHMSVVRARRNDSGTYLCGAISLAPKAQIKESLRAELRVTER

SEQ ID NO: 647 - protein, 122 aa, Artificial Sequence
  PD-1 v1, v37 (6-127)
DSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKVQIKESLLVELRVTER

SEQ ID NO: 648 - protein, 122 aa, Artificial Sequence
  PD-1 v2 (6-127)
DSPDRPWSPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRVELRVTER

SEQ ID NO: 649 - protein, 122 aa, Artificial Sequence
  PD-1 v3 (6-127)
DSPDRPWNPPTFSPALLVVTEGDNATFTYSFSNTSESFVLNWYRMSPSDQTDKLAAFPEDRSQPGQDCRFRVTQLPNGRDFHMSVVRARRNDSGSYLCGAISLAPKVQIKESLRVELRVTER

SEQ ID NO: 650 - protein, 122 aa, Artificial Sequence
  PD-1 v4 (6-127)
DSPDRPWNPPTFSPALLVVTEGDNATFTCSFSNTSESFVLNWYRVSPSNQTDKLAAFPEDRNQPGQDCRFRVTQQPNGRDFHMSVVRARRNDSGTYLCGAISLAPKAQIKESLRVELRVTER

SEQ ID NO: 651 - protein, 122 aa, Artificial Sequence
  PD-1 v5 (6-127)
DSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKVQIKESLWAELRVTER

SEQ ID NO: 652 - protein, 122 aa, Artificial Sequence
  PD-1 v6 (6-127)
DSPDRPWNPPTFSPALLVVTEGDNATFTCSFSNTSESFVLNWYRMSPSNQTDKLAAFPEDRSQPGQDCRFRVTQLPNGHDFLMSVVRARRNDSGTYLCGAISLAPKVQIKESLWAELRVTER

SEQ ID NO: 653 - protein, 122 aa, Artificial Sequence
  PD-1 v7 (6-127)
DSPDRPWNPPTFSPALLVVTEGDNATFTCSFSNTSESFVLNWYRMSPSNQTDKLAAFPEDRSQPGRDCRFRVTQLPNGRDFHMSVIRARRNDSGTYLCGAISLAPKVQIKESLLVELRVSER

SEQ ID NO: 654 - protein, 122 aa, Artificial Sequence
  PD-1 v8 (6-127)
DSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKVQIEESLRAELRVTER

SEQ ID NO: 655 - protein, 122 aa, Artificial Sequence
  PD-1 v9 (6-127)
DSPDRPWNPPTFSPALLVVTEGDNATFTCSFSNTSESFVLNWYRLSPSNQTDKVAAFPEDHSQPGQDCRFRVTQLPNGRDFHMSVVRARRNDSGTYLCGAISLAPKVQIKESLRAELRVTER

SEQ ID NO: 656 - protein, 122 aa, Artificial Sequence
  PD-1 v10, v12 (6-127)
DSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLWAELRVTER

SEQ ID NO: 657 - protein, 122 aa, Artificial Sequence
  PD-1 v11 (6-127)
DSPDRPWNPPTFSPALLVVTEGDNATFTCSFSNTSESFVLNWYRMSPGNRTDKLAAFPEDRSQPGQDCRFRVTQLPNGRDFHMSVVRARRNDSGTYLCGAISLAPKVQIEESLRVELRVTER

SEQ ID NO: 658 - protein, 122 aa, Artificial Sequence
  PD-1 v138 (6-127)
DSPNRPWNPPTISPALLVVTEGDNANFTCSFSNTPESFVLNWYRLSPSNQTDKLAAFPEDRIQPGQDSRFRVTQLPNGRDFHMSVVGVRRNDSGTYLCGAISLAPKVQIKESLRVELRVTER

SEQ ID NO: 659 - protein, 122 aa, Artificial Sequence
  PD-1 v13 (6-127)
DSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRVELRVIER

SEQ ID NO: 660 - protein, 122 aa, Artificial Sequence
  PD-1 v14, v27, v67 (6-127)
DSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKVQIKESLRVELRVTER

SEQ ID NO: 661 - protein, 122 aa, Artificial Sequence
  PD-1 v15 (6-127)
DSPDRPWNPPTISPALLVVTEGDNATFTCSFSNTSESFVLNWYRMSPSNQTDKLAAFPEDRSQPGQDCRFRVTQLPNGRDFHMSVVRARRNDSGTYLCGAISLAPEVQIKESLRVELRVTER

SEQ ID NO: 662 - protein, 122 aa, Artificial Sequence
  PD-1 v16 (6-127)
DSPDRPWNPPTFTPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLQAELRVTER

SEQ ID NO: 663 - protein, 122 aa, Artificial Sequence
  PD-1 v17 (6-127)
DSPDRPWNPPTFSPALLVVTEGDNATFTCSLTNTSESFVLNWYRMSPSNQTDKLAAFPEDRSQPGQDCRFRVTQLPNGRDFHMSVVRARRNDSGTYLCGAISLAPKVQIKESLRAELRVTER

SEQ ID NO: 664 - protein, 122 aa, Artificial Sequence
  PD-1 v18 (6-127)
DSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKVQIKESLRAELRVIER

SEQ ID NO: 665 - protein, 122 aa, Artificial Sequence
  PD-1 v19 (6-127)
DSPDRPWNPPTFSPALLVVTEGDNATFTCSFSNTSESFVLNWYRISPSNQTDKLAAFPEDRSQPGQDCRFRVTQLPNGRDFHMSVVRARRNDSGTYLCGAISLAPKVQIKESLRVELRVTER

SEQ ID NO: 666 - protein, 122 aa, Artificial Sequence
  PD-1 v20 (6-127)
DSPDRPWNPPTFSPALLVVTEGDNATFTCSFSNTSESFVLNWYRMSPSNQTDKLAAFPEDRNQPGQDRRFRVTQLPNGRDFHMSVVRVRRNDSGTYLCGAISLAPKVQIKESLRVELRVTER

SEQ ID NO: 667 - protein, 122 aa, Artificial Sequence
  PD-1 v21 (6-127)
DSPDRPWNPPTFSPALLVVTEGDNATFTCSFSNTSESFVLNWYRMSPSNQTDKLAAFPEDRSQPGQGCRFRVTQLPNGRDFHMSVVRARRNDSGTYLCGAISLAPKVQIKESLRVELRVTER

SEQ ID NO: 668 - protein, 122 aa, Artificial Sequence
  PD-1 v22 (6-127)
DSPDRPWNPPTFSPALLVVTEGDNATFTCSFSNTSESFVLNWYRMSPSNQTDKLAAFPEDRSQPGQDCRFRVTQLPNGRDFHMSVVRARRDDSGTYLCGAISLAPKVQIKESLRVELRVSER

SEQ ID NO: 669 - protein, 122 aa, Artificial Sequence
  PD-1 v23 (6-127)
DSPDRPWNPPTFSPALLVVTEGDNATFTCSFSNTSESFVLNWYRMSPSNQTDKLAAFPEDRSQPGQDCRFRVTQLPNGRDYHMSVVRARRNDSGTYLCGAISLAPKAQIKESLWAELRVIER

SEQ ID NO: 670 - protein, 122 aa, Artificial Sequence
  PD-1 v24 (6-127)
DSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLPAELRVTER

SEQ ID NO: 671 - protein, 122 aa, Artificial Sequence
  PD-1 v25 (6-127)
DSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPMVQIEESLRAELRVTER

SEQ ID NO: 672 - protein, 122 aa, Artificial Sequence
  PD-1 v26 (6-127)
DSPDRPWNPPTFSPALLVVTEGDNATFTCSFSNTSESFVLNWYRMSPSNQTDKLAAFPEDRGQPGQDCRFRVTQLPNGRDFHMSVVRARRNDSGTYLCGAISLAPKVQIKESLRAELRVIER

SEQ ID NO: 673 - protein, 122 aa, Artificial Sequence
  PD-1 v139 (6-127)
DSPDRPWDPPTFSPALLVVTEGDNATFTCSFSNTTESFVLNWYRMSPSNQMDKLAAFPEDRNQPGQDCRFRVTQLPNGRDFHMSVVRARLNDSGTYLCAAISLAPRVQIKESLRVELRVIER

SEQ ID NO: 674 - protein, 122 aa, Artificial Sequence
  PD-1 v28 (6-127)
DSPDRPWNPPTFSPALLVVTEGDNATFTCSFPNTSESFVLNWYRMSPSNQTDKLAAFPEDRSQPGQDCRFRVTQLPNGRDFHMSVVRARRNDSGTYLCGAISLAPKVQIKESLWAELRVTER

SEQ ID NO: 675 - protein, 122 aa, Artificial Sequence
  PD-1 v29 (6-127)
DSPDRPLNPPTFSPALLVVTEGDNATFTCSFPNTSESFVLNWYRMSPSNQTDKLAAFPEDRSQPGQDCRFRVTQLPNGRDFHMSVVRARRNDSGTYLCGAISLAPKVQIKESLWAELRVTER

SEQ ID NO: 676 - protein, 122 aa, Artificial Sequence
  PD-1 v30 (6-127)
DSPGRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKVQIKESLRVELRVTER

SEQ ID NO: 677 - protein, 122 aa, Artificial Sequence
  PD-1 v31 (6-127)
DSPDRPWNPPTFSPALLVVTEGDNASFTCSFTNTSESFVLNWYRMSPSNQTDKLAAFPEDRSQPGQDCRFRVTQLPNGRDFHMSVVRARRNDSGTYLCGAISLAPKVQIKESLRAELRVIER

SEQ ID NO: 678 - protein, 122 aa, Artificial Sequence
  PD-1 v32 (6-127)
DSPDRPWNPPTFSPALLVVTEGDNATFTCSFTNTSESFVLNWYRMSPSNQTDKLAAFPEDRSQPGQDCRFRVTQLPNGRDFHMSVVRARRNDSGTYLCGAISLAPKVQIKESLRAELRVIER

SEQ ID NO: 679 - protein, 122 aa, Artificial Sequence
  PD-1 v33 (6-127)
DSPDRPWNPPTFSPALLVVTEGDNATFTCSFSNTSESFVLNWYRMSPSNQTDKLAAFPEDRSQPGQDCRFRVTQLPNGRDFHMSVVGARRNDSGTYLCGAISLAPKVQIKESLRVELRVTER

SEQ ID NO: 680 - protein, 122 aa, Artificial Sequence
  PD-1 v34 (6-127)
DSPDRPWNPPTFSPALLVVTEGDNATFTCSFSNTSESFVLNWYRMSPSNQTDKLAAFPDDRSQPGQDCRFRVTQLPNGRDYHMSVVRARRNDSGTYLCGAISLAPKVQIKESLRVELRVTER

SEQ ID NO: 681 - protein, 122 aa, Artificial Sequence
  PD-1 v35 (6-127)
DSPDRPWNPPTFSPALLVVTEGDNATFTCSFSNTSESFVLNWYRMSPSNQTDKLAAFPEDRSQPGQDCRFRVTQLPNGRDFRMSVVRARRNDSGTYLCGAISLAPKVQIKESLWAELRVTER

SEQ ID NO: 682 - protein, 122 aa, Artificial Sequence
  PD-1 v36 (6-127)
DSPDRPWDPPTFSPALLVVTEGDNATFTCSFSNTSESFVLNWYRMSPSNQTDKLAAFPEDRSQPGQDCRFRVTQLPNGRDFHMSVVRARRNDSGTYLCGVISLAPKVQIKESLRVELRVTER

SEQ ID NO: 683 - protein, 122 aa, Artificial Sequence
  PD-1 v140 (6-127)
DSPDRPGNPPTISPALLVVTEGDNATFTCSFSNTPESFVLNWYRLSPSNQTDKLAAFPEDRSQPGQDCRFRVTQLPNGRDFHMSVVRARRNDSGTYLCGAISLAPKVQIKESLRAELRVTER

SEQ ID NO: 684 - protein, 122 aa, Artificial Sequence
  PD-1 v38 (6-127)
DSPDRPWNPPIFSPALLVVTEGDNATFTCSFSNTSESFVLNWYRISPSNQTDKLAAFPEDRSQPGQDCRFRVTQLPNGRDFHMSVVRARRNDSGTYLCGAISLAPKVQIKESLRVELRVTER

SEQ ID NO: 685 - protein, 122 aa, Artificial Sequence
  PD-1 v39 (6-127)
DSPDRPWNPPTFSPALLVVTEGDNATFTCSFSNTSESFVLNWYRLSPSNQTDKLAAFPEDRSQPGQDCRFRVTQLPNGRDFHMSVVRARRNDSGTYLCGAISLAPKVQIKESLQVELRVIER

SEQ ID NO: 686 - protein, 122 aa, Artificial Sequence
  PD-1 v40 (6-127)
DSPDRPWNPPTFSPALLVVTEGDNATFTCSFSNTSESFVLNWYRMSPSNQTVKLAAFPEDRSQPGQDCRFRVTQLPNGRDFHMSVVRARRNDSGTYLCGAISLAPKVQIKESLRAELRVTER

SEQ ID NO: 687 - protein, 122 aa, Artificial Sequence
  PD-1 v41 (6-127)
DSPDRPWNPPTFSPALLVVTEGDNATFTCSFSNTSESFVLNWYRMSPSNQTDKLAAFPEDRNQPGQDCRFRVTQLPNGRDFHMSVVRARRNDSGTYLCGAISLAPKAQIKESLWAELRVTER

SEQ ID NO: 688 - protein, 122 aa, Artificial Sequence
  PD-1 v42 (6-127)
DSPDRPWNPPTFSPALLVVTEGDNATFTCSFSNTSESFVLNWYRMSPSNQTDKLAAFPEDRNQPGQDCRFRVTQLPNGRDFHMSVVRARRNDSGTYLCGAISLAPKVQIKESLRVELRVTER

SEQ ID NO: 689 - protein, 122 aa, Artificial Sequence
  PD-1 v43 (6-127)
DSPDRPWNPPTFSPALLVVTEGDNATFTCSFSNTSESFVLNWYRMSPSYQTDKLAAFPEDRSQPGQDCRFRVTQLPNGRDFHMSVVRARRNDSGTYLCGAISLAPKVQIKESLRAELRVTER

SEQ ID NO: 690 - protein, 122 aa, Artificial Sequence
  PD-1 v44 (6-127)
DSPDRPWNPPTFSPALLVVTEGDNATFTCSFSNTSESYVLNWYRMSPSNQTDKLAAFPEDRSQLGQDCRFRVTQLPNGRDFHMSVVRARRNDSGTYLCGAISLAPKAQIKESLWAELRVTER

SEQ ID NO: 691 - protein, 122 aa, Artificial Sequence
  PD-1 v45 (6-127)
DSPDRPWNPPTFSPALLVVTEGDNATFTCSFSNTSESFVLNWYRMSPSYQTDKLAAFPEDRSQPGQDCRFRVTQLPNGRDFHMSVVRARRNDSGTYLCGAISLAPKVQIKESLWAELRVTER

SEQ ID NO: 692 - protein, 122 aa, Artificial Sequence
  PD-1 v46 (6-127)
DSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRVELRVTER

SEQ ID NO: 693 - protein, 122 aa, Artificial Sequence
  PD-1 v47 (6-127)
DSPDRPWNPPTFSPALLVVTEGDNATFTCSFSNTSESFVLNWYRMSPSNQMDKLAAFPEDRSQPGQDSRFHVTQLPNGRDFHMSVVRARRNDSGTYLCGAISLAPKVQIKESLLVELRVTER

SEQ ID NO: 694 - protein, 122 aa, Artificial Sequence
  PD-1 v48 (6-127)
DSPDRPWNPPTISPALLVVTEGDNATFTCSFSNTPDSFVLNWYRMSPSNQTDKLAAFPEDRNQPGQDCRFRVTQLPNGRDFHMSVVRARLNDSGTYLCGAISLAPKVQIKESLRVELRVIER

SEQ ID NO: 695 - protein, 122 aa, Artificial Sequence
  PD-1 v49 (6-127)
DSPDRPWNPPTLSPALLVVTEGDNASFTCNFSNTSESFVLNWYRMSPSNQTDKLAAFPEDRSQPGQDCRFRVTQLSNGRDFHMSVVRARRSDSGTYLCGAISLAPKVQIKESLWAELRVTER

SEQ ID NO: 696 - protein, 122 aa, Artificial Sequence
  PD-1 v50 (6-127)
DSPDRPWNPPTFSPALLVVTEGDNATFTCSFSNTSESLVLNWYRMSPSNQTDKLAAFPEDRNQPGQDRRFRVTQLPNGRDFHMSVVRARRNDSGTYLCGAISLAPKVQIKESLRVELRVTER

SEQ ID NO: 697 - protein, 122 aa, Artificial Sequence
  PD-1 v51 (6-127)
DSPDRPLNPPTFSPALLVVTEGDNATFTCSFSDTSESFVLNWYRMSPSNQTDKLAAFPEDRSQPGQDCRFRVTQLPNGRDFHMSVVRARRNDSGTYLCGAISLAPKVQIKESLQVELRVTER

SEQ ID NO: 698 - protein, 122 aa, Artificial Sequence
  PD-1 v52 (6-127)
DSPDRPWNPPTFSPALLVVTEGDNATFTCSFSNTSESFVLNWYRMSPSNQTDKLAAFPEDRNQHGQDRRFRVTPLPNGRDFHMSVDRARRNDSGTYLCGAISLAPKVQIKESLRVELRVTER

SEQ ID NO: 699 - protein, 122 aa, Artificial Sequence
  PD-1 v53 (6-127)
DSPDRPWNPPTISPALLVVTEGDNATFTCSFSNTPESFVLNWYRMSPSNQTDKLAAFPEDRNQPGQDCRFRVTRLPNGRDFHMSVVRARRNDSGTYLCGAISLAPKVQIKESLWAELRVIER

SEQ ID NO: 700 - protein, 122 aa, Artificial Sequence
  PD-1 v54 (6-127)
DSPDRPWNPPTFSPALLVVTEGDNATFTCSFSNTSESYVLNWYRVSPSNQTDKLAAFPEDRNQPGQDRRFRVTQLPNGRDFHMSVVGARRNDSGTYLCGAISLAPKVQIKESLRVELRVTER

SEQ ID NO: 701 - protein, 122 aa, Artificial Sequence
  PD-1 v55 (6-127)
DSPDRPWNPPTLSPALLVVTEGDNATFTCSFSNTSESFVLNWYRMSPSNQMDKLAAFPEDRNQPGQDCRFRVTQLPNGRDFHMSVVRARRNDSGTYLCGAISLAPKVQIKESLWVELRVTER

SEQ ID NO: 702 - protein, 122 aa, Artificial Sequence
  PD-1 v56 (6-127)
DSPDRPLNPPTFSPALLVVTEGDNATFTCSFSNTSESFVLNWYRMSPSYQTDKLAAFPEDRNQPGQDCRYRVTQLPNGRDFHMSVDRARLNDSGTYLCAAISLAPKVQIKESLWAELRVTER

SEQ ID NO: 703 - protein, 122 aa, Artificial Sequence
  PD-1 v57 (6-127)
DSPDRPWNPPTLSPALLVVTEGDNATFTCSFTNTSESFVLNWYRMSPSNQTDKLAAFPEDRNQPGQDCRFRVSQLPNGRDYHMSVVRARRNDSGTYLCGAISLAPKVQIKESLHVELRVTER

SEQ ID NO: 704 - protein, 122 aa, Artificial Sequence
  PD-1 v58 (6-127)
DSPDRPWDPPTFSPALLVVTEGDNATFTCSFSNTPESFVLNWYRMSPSNQTDKLAAFPEDRSQPGQDCRFRVTQLPNGRDFHMSVVRARRNDSGTYLCGAISLAPKVQIKESLLVELRVTER

SEQ ID NO: 705 - protein, 122 aa, Artificial Sequence
  PD-1 v59 (6-127)
DSPDRPWNPPTVSPALLVVTEGDNVTFTCSFSNTSVSFVLNWYRMSPSNQTDKLAAFPEDRSQPGQDCRFSVTQLPNGRDFHMSVVRARRNDSGTYLCGAISLAPKVQIKESLQVELRVTER

SEQ ID NO: 706 - protein, 122 aa, Artificial Sequence
  PD-1 v60 (6-127)
DSPDRPWNPPTISPALLVVAEGDNATFTCSFSNTSESFVLNWYRVSPTNQTDKLAAFPEDSRQPGQDCRFRVTQLPNGRDFHMSVVRARRNDSGTYLCGAITLAPKVQIKESLWAELRVTER

SEQ ID NO: 707 - protein, 122 aa, Artificial Sequence
  PD-1 v61 (6-127)
DSPDRPWDPPTFSPALLVVTEGDNATFTCSFSNTPESFVLNWYRMSPSNQTDKLAAFPEDRNQPGQDRRFRVTQLPNGRDFHMSVVRARLNDSGTYLCAAISLAPKVQIKESLRVELRVTER

SEQ ID NO: 708 - protein, 122 aa, Artificial Sequence
  PD-1 v62 (6-127)
DSPDRPWNPPTFSPALLVVTEGDNATFTCSFSNTPESFVLNWYRMSPSNQADKLAAFPEDRNQPGQDRRFRVTQLPNGRDFHMSVVRARRNDSGTYLCGAISLAPKVQIKESLQVELRVTER

SEQ ID NO: 709 - protein, 122 aa, Artificial Sequence
  PD-1 v63 (6-127)
DSPDRPWYPPTFSPALLVVTEGDNATFTCSFSNTPESLVLNWYRMSPSNQTDKLAAFPEDRSPPGQDCRFRVTQLPNGRDFHMSVVGARRNDSGTYLCGAISLAPKVQIKESLLVELRVTER

SEQ ID NO: 710 - protein, 122 aa, Artificial Sequence
  PD-1 v64 (6-127)
DSPDRPWNPPTLSPALLVVTEGDNATFTCSFSNTSESFVLNWYRMSPSNQTDKLAAFPEDRNQPGLDSRFRVTQLPNGRDFHMSVVRARRNDSGTYLCGAISLAPKVQIKESLQVELRVTER

SEQ ID NO: 711 - protein, 122 aa, Artificial Sequence
  PD-1 v65 (6-127)
DSPDRPWNPPTISPALLVVTEGDNATFTCSFSNTPESFVLNWYRMSPSNQTDKLAAFPEDRSQSGQDSRFRVTQLPNGRDFHMSVVRARRSDSGTYLCAAISLAPKVQIKESLRVELRVTER

SEQ ID NO: 712 - protein, 122 aa, Artificial Sequence
  PD-1 v66 (6-127)
DSPDRPWNPPTISPALLVVTEGDNATFTCSFSNTPESFVLNWYRMSPSNQTDKLAAFPEDRSQPGQDCRFRVTQLPNGRDFHMSVVRARRNDSGTYLCGAISLAPKVQIKESLLVELRVTER

SEQ ID NO: 713 - protein, 122 aa, Artificial Sequence
  PD-1 v141 (6-127)
DSPNRPWNPPTISPALLVVTEGDNATFTCSFSNTPESFVLNWYRTSPSNQADKLAAFPEDRSQPSQDRRFRVTQLPNGRDFHMSVVGVRRNDSGTYLCGAISLAPKVQIKESLRVELRVTER

SEQ ID NO: 714 - protein, 122 aa, Artificial Sequence
  PD-1 v68 (6-127)
DSPDRPWNPPTFSPSLLVVTEGDNATFTCSFSNTSESFVLNWYRMSPSNQTDKLAAFPEDRNQPGQDRRFRVTQLPNGRDFHMSVVRAQRNDSGTYLCGAISLAPKVQIKESLQVELRVIER

SEQ ID NO: 715 - protein, 122 aa, Artificial Sequence
  PD-1 v69 (6-127)
DSPDRPWDPPTFSPALLVVTEGDNATFTCSFSNTSESFVLNWYRMSPSNQTDKLAAFPEDRNQPGQDRRFRVTQLPNGRDFHMSVVRARLNDSGTYLCGAISLAPKVQIKESLQVELRVIER

SEQ ID NO: 716 - protein, 122 aa, Artificial Sequence
  PD-1 v70 (6-127)
DSPDRPWNPPTFSPALLVVTEGDNATFTCSFSNTPESFVLNWYRMSPSNQTDKLAAFPEDRNQPGQDRRFRVTQLPNGRDFHMSVVRARRTDSGTYLCGAISLAPKVQIKESLRVELRVTER

SEQ ID NO: 717 - protein, 122 aa, Artificial Sequence
  PD-1 v71 (6-127)
DSPDRPWNPPTFSPAVLVVTEGDNATFTCSFSNTPESFVLNWYRMSPSNQTDKLAAFPEDRSQPGQDCRFRVTQLPNGRDFHMSVVRARLNDSGTYLCAAISLAPKVQIKESLRVELRVTER

SEQ ID NO: 718 - protein, 122 aa, Artificial Sequence
  PD-1 v72 (6-127)
DSPDRPWNSPTFSPALLVVTEGDNATFTCSFSNTPERFVLNWYRMSASNQMDKLAAFPEDRSQPGQDCRFRVTQLPNGRDFHMSVVRARRNDSGTYLCGAISLAPKVQIKESLWAELRVIER

SEQ ID NO: 719 - protein, 122 aa, Artificial Sequence
  PD-1 v73 (6-127)
DSPDRPWNPPTFSPALLVVTEGDNATFTCSFSNTPESLVLNWYRMSPSNQADKLAAFPEDRNQPGQDSRFRVTQLPNGRDFHMSVVRARRNDSGTYLCGAISLAPKVQIKESLLVELRVTER

SEQ ID NO: 720 - protein, 122 aa, Artificial Sequence
  PD-1 v74 (6-127)
DSPDRPWNPPTISPALLVVTEGDNATFTCSFSNTPESFVLNWYRVSPSNQTDKLAAFPEDRNQPGQDSRFRVTQLPNGRDFHMSVVRARLNDSGTYLCAAISLAPKVQIKESLLVELRVTER

SEQ ID NO: 721 - protein, 122 aa, Artificial Sequence
  PD-1 v75 (6-127)
DSPDRPWNPPTFSPALLVVTEGDNATFTCSFSNTPESFVLNWYRMSPSNQMDKLAAFPEDRSQPGQDSRFRVTQLPNGRDFHMSVVRARLNDSGTYLCGAISLAPKVQIKESLWAELRVIER

SEQ ID NO: 722 - protein, 122 aa, Artificial Sequence
  PD-1 v76 (6-127)
DSPDRPWNPPTISPVLLVVTEGDNATFTCSFSNTSESFVLNWYRMGPSDQTDKLAAFPEDRSQPGQDCRFRVTQLPNGRDYHMSVVRARRNDSGTYLCGAISLAPKVQIKESLRVELRVIER

SEQ ID NO: 723 - protein, 122 aa, Artificial Sequence
  PD-1 v77 (6-127)
DSPDRPWNPPTISPALLVVTEGDNANFTCSFSNTSESFVLNWYRMSPSNQMDKLAAFPEDRNQPGQDRRFRVTQLPNGRDFHMSVVRARRNDSGTYLCAAISLAPKVQIKESLQVELRVTER

SEQ ID NO: 724 - protein, 122 aa, Artificial Sequence
  PD-1 v78 (6-127)
DSPDRPWNPPTVSPALLVVTEGDNATFTCSFSNTPESFVLNWYRMSPSNQTDKLAAFPEDRSQPGQDCRFRVTQLPNGRDFHMSVVGARLNDSGTYLCGAISLAPKVQIKESLWAELRVTER

SEQ ID NO: 725 - protein, 122 aa, Artificial Sequence
  PD-1 v79 (6-127)
DSPDRPGNPPTLSPALLVVTEGDNATFTCSFSNTSESFVLNWYRMSPSNQVDKLAAFPEDRNQPGQDCRFRVTQLPNGRDFHMSVVRARRNDSGTYLCGAISLAPKVQIKESLWAELRVTER

SEQ ID NO: 726 - protein, 122 aa, Artificial Sequence
  PD-1 v80 (6-127)
DSPDRPWNPPTFSPALLVVTEGDNATFTCSFSNTSESFVLNWYRMSPSNQTDKLAAFPEDRSQPGQDCRFRVTQLPNGRDYHMSVVGARRNDSGTYLCGAISLAPKVQIKESLLVELRVKER

SEQ ID NO: 727 - protein, 122 aa, Artificial Sequence
  PD-1 v81 (6-127)
DSTDRPWNPPTISPALLVVTEGDNATFTCSFSNTSESFVLNWYRMSPSNQTDKLAAFPEDRNQPGQDCRFRVTQLPNGRDYHMSVVRARRNDSGTYLCAAISLAPKVQIKESLRVELRVTER

SEQ ID NO: 728 - protein, 122 aa, Artificial Sequence
  PD-1 v82 (6-127)
DSPDRPWNPPTISPALLVVTEGDNATFTCSFSNTPESFVLNWYRMSPSNQTDKLAAFPEDRSQPGQDCRFRVTQLPNGRDFHMSVVRARRNDSGTYLCGAISLAPKVQIKESLWAELRVTER

SEQ ID NO: 729 - protein, 122 aa, Artificial Sequence
  PD-1 v83 (6-127)
DSPDRPWNPPTFSPALIVVTEGDNATFTCSFSNTSESFVLNWYRMSPSNQTDKLAAFPEDRIQPSRDCRFRVTQLPNGRDFHMSVVRARRNDSGTYLCGAITLAPKVQIKESLLVELRVIER

SEQ ID NO: 730 - protein, 122 aa, Artificial Sequence
  PD-1 v84 (6-127)
DSPDRPWNPPTFSPALLVVTEGDNATFTCSFSNTPESFVLNWYRMSPSNQTDKLAAFPEDRSQPGQDCRFRVTQLPNGRDFHMSVVRARRNDSGTYLCGAISLAPKVQIKESLRVELRVTER

SEQ ID NO: 731 - protein, 122 aa, Artificial Sequence
  PD-1 v85 (6-127)
DSPDRPWNPPSFSPALLVVTEGDNATFTCSFSNTSESFVLNWYRMSPSNQTDKLAAFPEDRNQPGQDRRFRVTQLPNGRDFHMSVVRARRNDSGTYLCGAISLAPKVQIKESLWAELRVTER

SEQ ID NO: 732 - protein, 122 aa, Artificial Sequence
  PD-1 v86 (6-127)
DSPDRPWDPPTFSPALLVVTEGDNATFTCSFSNTPESFVLNWYRMSPSNQTDKLAAFPEDRSQPGQDCRFRVTQLPNGRDFHMSVVRARRNDSGTYLCGAISLAPKVQIKESLRVELRVIER

SEQ ID NO: 733 - protein, 122 aa, Artificial Sequence
  PD-1 v87 (6-127)
DSPDRPWNPPTFSPALLVVTEGDNATFTCSFSNTSESFVLNWYRLSPSNQTDKLAAFPEDRSQPGQDCRFRVTQLPNGRDFHMSVDRARRNDSGTYLCGAISLAPKVQIKESLWAELRVTER

SEQ ID NO: 734 - protein, 122 aa, Artificial Sequence
  PD-1 v88 (6-127)
DSPDRPWNPPTISPALLVVTEGDNATFTCSFSNTPESFVLNWYRISPSNQTDKLAAFPEDRRQPGQDCRFRVTQLPNGRDFHMSVVRARRNDSGTYLCGAISLAPKVQIKESLLVELRVTER

SEQ ID NO: 735 - protein, 122 aa, Artificial Sequence
  PD-1 v90 (6-127)
DSPDRPWNPPTISPALLVLTEGDNATFTCSFSNTSESFVLNWYRMSPSNQTDKLAAFPEDRSQPGQDCRFRVTQLPNGRDFHMSVVRARRNDSGTYLCGAISLAPKVQIKESLWAELRVTER

SEQ ID NO: 736 - protein, 122 aa, Artificial Sequence
  PD-1 v91 (6-127)
DSPDRPWNPPTFSPALLVVTEGDNATFTCSFSNTPESFVLNWYRMSPSNQTDKLAAFPEDRNQPGQDRRFRVTQLPNGRDFHMSVVRVRRNDSGTYLCGAISLAPKVQIKESLRVELRVTER

SEQ ID NO: 737 - protein, 122 aa, Artificial Sequence
  PD-1 v92 (6-127)
DSPDRPWDPPTISPALLVVTEGDNATFTCSFSNTSESFVLNWYRMSPSNQTDKLAAFPEDRSQPGQDCRFRVTQLPNGRDFHMSVVRARRNDSGTYLCGAISLAPKVQIKESLWAELRVTER

SEQ ID NO: 738 - protein, 122 aa, Artificial Sequence
  PD-1 v93, v117 (6-127)
DSPDRPWNPPTFSPALLVVTEGDNATFTCSFSNTSESFVLNWYRMSPSNQTDKLAAFPEDRNQPGQDRRFRVTQLPNGRDFHMSVVRARRNDSGTYLCGAISLAPKVQIKESLRVELRVTER

SEQ ID NO: 739 - protein, 122 aa, Artificial Sequence
  PD-1 v95 (6-127)
DSPDRPWNPPTFSPALLVVTEGDNATFTCSLSNTSESFVLNWYRIGPSNQTDKLAAFPEDRSQPGQDRRFRVTQLPNGRDFHMSVVRARRNDSGTYLCGAITLAPMAQIKESLRVELRVTER

SEQ ID NO: 740 - protein, 122 aa, Artificial Sequence
  PD-1 v96 (6-127)
DSPDRPWNPPTFSPALLVVTEGDNATFTCSFSNTSESFVLNWYRVSPSNQTDKLAAFPEDRSQPGQDCRFRVTQLPNGRDFHMSVVRARRNDSGTYLCGAISLAPKAQIKESLWVELRVIER

SEQ ID NO: 741 - protein, 122 aa, Artificial Sequence
  PD-1 v97 (6-127)
DSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLGPKVQIEESLWAELRVTER

SEQ ID NO: 742 - protein, 122 aa, Artificial Sequence
  PD-1 v98 (6-127)
DSPDRPWNPPTFSPALLVVTEGDNATFTCSFSNTSESFVLNWYRMSPSNRTDKLAAFPEDRSQPGQDCRFHVTQLPNGRDFHMSVVRARRNDSGTYLCGAISLAPKVQIIESLRVELRVTER

SEQ ID NO: 743 - protein, 122 aa, Artificial Sequence
  PD-1 v99 (6-127)
DSPDRPRNPPTFSPALLVVTEGDNATFTCSFSNTSESFVLNWYRMSPSNQTDKLAAFPEDRSQPGQDCRFRVTQLPNGRDYHMSVVRARLNDSGTYLCGAISLAPKVQIKESLPAELRVTER

SEQ ID NO: 744 - protein, 122 aa, Artificial Sequence
  PD-1 v100 (6-127)
DSPDRPWNPPTFSPALLVVTEGDNATFTCSFSNTSESFVLNWYRMSPSNQTDKLAAFPEDRNQPGQDYRFRVTQLPNGRDFHMSVVRARRNDSGTYLCGAISLAPKVQIKESLRAELRVTER

SEQ ID NO: 745 - protein, 122 aa, Artificial Sequence
  PD-1 v102 (6-127)
DSPDRPLNSPTFSPALLVVTEGDNATFTCSFSNTSESFVLNWYRVSPSNQTDKLAAFPEDRRQPGQDCRFRVTQLPNGRDFHMSVVRVQRNDSGTYLCGAISLAPTVQIKESLWVELRVTER

SEQ ID NO: 746 - protein, 122 aa, Artificial Sequence
  PD-1 v103 (6-127)
DSPDRPWNPPTFSPALLVVTEGDNATFTCSLSNTSESFVLNWYRMSPSNQTDKRAAFPEDRNQPGQDCRFRVTQLPNGRDFHMSVVRARRNDSGTYLCGLISLAPKVQIKESLWVELRVTER

SEQ ID NO: 747 - protein, 122 aa, Artificial Sequence
  PD-1 v104 (6-127)
DSPDRPWNPPTFSPALLVVTEGDNATFTCSFSNTSESFVLNWYRMSPSNQTDKMAAFPKDRSQPGQDCRFRVTQLPNGRDYHMSVVRAQRNDSGTYLCGAISLAPKVQIKESLLVELRVIER

SEQ ID NO: 748 - protein, 122 aa, Artificial Sequence
  PD-1 v105 (6-127)
DSPDRPWNHPTYSPALLVVTEGDNATFTCSFSNRTESFVLNWYRMSPSNQTDRLAAFPEDRSQPGQDCRFRDTQLPNGRDFHMSVVRARRNDSGTYLCVAISLAPKVRTKESLRAELRVTER

SEQ ID NO: 749 - protein, 122 aa, Artificial Sequence
  PD-1 v106 (6-127)
DSPDRPWNPPTFSPALLVVTEGDNATFTCSFSNTSESFVLNWYRMSPSNQTVKMAAFPEDRSQSGQDSRFRVTQLPNGRDFHMSVVRARRNDSGTYLCGAISLAPKVQIKESLLVELRVTER

SEQ ID NO: 750 - protein, 122 aa, Artificial Sequence
  PD-1 v107 (6-127)
DSPDRPWNPPTFSPALLEVTEGDNATFTCSFSNSPESFVLNWYRMSPSNQTDKLAAFPEDRSQPGQDYRFRVTQLPNGRDFHMSVANARRNDSGTYFCGAISLAPKVQIKESLWVELRVTER

SEQ ID NO: 751 - protein, 122 aa, Artificial Sequence
  PD-1 v108 (6-127)
DSPDRPWNPPAISPALLVVTEGDNATFTCSLSNTSESFVLNWYRMSPSNQTDKLAAFPEDRNQPGQDRRFRVTQLPNGRDFLMSVVGARLNDSGTYLCGAISLAPKVQIKESLWAELRVTER

SEQ ID NO: 752 - protein, 122 aa, Artificial Sequence
  PD-1 v109 (6-127)
DSPDRPWNPPTFSPALLVVTEGDNATFTCSFSNTSESFVLNWYRMSPSNQTDKLAAFPEDRSQPGQDSRFRVTQLPNGRDFHMSVVRARRNDSGTYLCGVISLAPKVQIKESLWVELRVTER

SEQ ID NO: 753 - protein, 122 aa, Artificial Sequence
  PD-1 v110 (6-127)
DSPDRPWNSPTFSPALLVVTEGDNATFTCSFSNTSESFVLNWYRLSPSNQTDKVAAFPEDHSQPSQDRRFRVTQLPNGRDFHMSVVRARRNDSGTYLCGAISLAPKVQIKESLRVELRVIER

SEQ ID NO: 754 - protein, 122 aa, Artificial Sequence
  PD-1 v111 (6-127)
DSTDRPWNPPTFSPALLVVTEGDNATFTCSFSNTPESFVLNWYRMSPNNQTDKLAAFPEDRSQPGQDCRFRVTQLPNGRDFHMSVVRARLNDSGTYLCGAISLAPKVQIKESLRVELRVIER

SEQ ID NO: 755 - protein, 122 aa, Artificial Sequence
  PD-1 v112 (6-127)
DSPDRPWNPPTFSPALLVVTEGDNATFTCSFTNTSESFVLNWYRMSPSNQMDKLAAFPEDRSQPGQDSRFRVTQLPNGRNFHMSVVRARRNDSGTYLCGAISLGPKVQIKESLRVELRVTER

SEQ ID NO: 756 - protein, 122 aa, Artificial Sequence
  PD-1 v113 (6-127)
DSPDRPWNPPTFSPALLVVTEGDNATFTCSFSNTSESFVLNWYRMSPSNQTDKLAAFPEDRNQPGQDRRFRVTQLPNGRDFHMSVVRVRRNDSGTYLCAAISLAPKVQIKESLQAELRVTES

SEQ ID NO: 757 - protein, 122 aa, Artificial Sequence
  PD-1 v114 (6-127)
DSPDRPWNPPTFSPALLVVTEGDNATFTCSFSNTPESFVLNWYRMSPSNQTDKLAAFPEDRNQPGQDRRFRVTQLPNGRDFHMSVVRARRNDSGTYLCGAISLAPKVQIKESLRVELRVTER

SEQ ID NO: 758 - protein, 122 aa, Artificial Sequence
  PD-1 v115 (6-127)
DSPDRPWNPPTFSPALLVVTEGDNATFTCSFSNTSESFVLNWYRMSPSNQTDKLAAFPEDRNQPGQDRRFRVTQLPNGRDFHMSVVRVRRNDSGTYLCGAISLAPKVQIKESLWAELRVTER

SEQ ID NO: 759 - protein, 122 aa, Artificial Sequence
  PD-1 v116 (6-127)
DSPDRPWNPPTFSPALLVVTEGDNATFTCSFSNTSESFVLNWYRMSPSNQTDKLAAFPEDRSQPGQDRRFRVTQLPNGRDFHMSVVRVRRNDSGTYLCGAISLAPKVQIKESLWAELRVTER

SEQ ID NO: 760 - protein, 99 aa, Artificial Sequence
  CD86 WT IgV
VTEGDNATFTCSFSNTSESFVLNWYRMSPSNQSDKLAAFPEDRSQPGQDCRFRVTQLPNGRDFHMSVVRARRNDSGTYLCGAISLAPKVQIKESLWAEL

SEQ ID NO: 761 - protein, 122 aa, Artificial Sequence
  PD-1 v118 (6-127)
DSPDRPWDPPTFSPALLVVTEGDNATFTCSFSNTSESFVLNWYRMSPSNQTDKLAAFPEDRSQHGQDRRFRVTQLPNGRDFHMSVVRVRRNDSGTYLCGAISLAPKVQIKESLWAELRVTER

SEQ ID NO: 762 - protein, 122 aa, Artificial Sequence
  PD-1 v119 (6-127)
DSPDRPWNPPTISPALLVVTEGDNATFTCSFSDTPESFVLNWYRMSPSNQTDKLAAFPEDRNQPGQDRRFRVTQLPNGRDFHMSVVRARRNDSGTYLCGAISLAPKVQIKESLRVELRVTER

SEQ ID NO: 763 - protein, 122 aa, Artificial Sequence
  PD-1 v120 (6-127)
DSPDRPWDPPTISPALLVVTEGDNATFTCSFSNTPESFVLNWYRMSPSNQMDKLAAFPEDSNQPCQDCRFRVTQLPNGRDFHMSVVRARRNDSGTYLCGAISLAPKVQIKESLRVELRVTER

SEQ ID NO: 764 - protein, 122 aa, Artificial Sequence
  PD-1 v121 (6-127)
DSPDRPWNPPTFSPALLVVTEGDNATFTCSFSNTPESLVLNWYRMSPSNQTDKLAAFPEDSNQPCQDCRFRVTQLPNGRDFHMSVVRARRNDSGTYLCGAISLAPKVQIKESLLVELRVTER

SEQ ID NO: 765 - protein, 122 aa, Artificial Sequence
  PD-1 v122 (6-127)
DSPDRPWNPPTFSPALLGVTEGDNATFTCSFSNTTESFVLNWYRMSPSNQTDKLAAFPEDRSQPGQDCRFRVTQLPNGRDFHMSVVRARRNDSGTYLCAAISLAPKVQIKESLLVELRVTER

SEQ ID NO: 766 - protein, 122 aa, Artificial Sequence
  PD-1 v123 (6-127)
DSPDRPRNPPTFSPALLVVTEGDNATFTCSISNTSESFVLNWYRMSPSYQTDKLAAFPEDRIQPGQDSRFRVTQLPNGRDFHMSVVRVRRNDSGTYLCAAISLAPKVQIQESLWAELRVTER

SEQ ID NO: 767 - protein, 122 aa, Artificial Sequence
  PD-1 v124 (6-127)
DSPDRPWNPPTFSPALLVVTEGDNATFTCSFSNTPESFVLNWYRLSPSNQTDKLAAFPEDRIQPGQDSRFRVTQLPNGRDFHMSVVGVRRNDSGTYLCGAISLAPKVQIKESLRVELRVTER

SEQ ID NO: 768 - protein, 122 aa, Artificial Sequence
  PD-1 v125 (6-127)
DSPDRPWNPPTISPALLVVAEGDNATFTCSFSNTPESYVLNWYRMSPSNQTDKLAAFPEDRNQPGQDRRFRVTQLPNGRDYHMSVVRARRNDSGTYLCGAISLAPKVQIKESLWAELRVIER

SEQ ID NO: 769 - protein, 122 aa, Artificial Sequence
  PD-1 v126 (6-127)
DSPDRPWNPPTISPALLVVTEGDNATFTCSFSNTPESFVLNWYRLSPSNQTDKLAAFPEDRIQPGQDSRFRVTQLPNGRDFHMSVVRARRNDSGTYLCGAISLAPKVQIKESLRVELRVTER

SEQ ID NO: 770 - protein, 122 aa, Artificial Sequence
  PD-1 v127 (6-127)
DSPDRPRNPPTFSPALLVVTEGDNATFTCSFSNTPESFVLNWYRMSPSNQTDKLAAFPEDRNQPGQDRRFRVTQLPNGRDFHMSVVRVRRNDSGTYLCGAISLAPKVQIKESLRVELRVTER

SEQ ID NO: 771 - protein, 122 aa, Artificial Sequence
  PD-1 v128, v135 (6-127)
DSPDRPWNPPTISPALLVVTEGDNATFTCSFSNTPESFVLNWYRLSPSNQTDKLAAFPEDRIQPGQDSRFRVTQLPNGRDFHMSVVGVRRNDSGTYLCGAISLAPKVQIKESLRVELRVTER

SEQ ID NO: 772 - protein, 122 aa, Artificial Sequence
  PD-1 v129 (6-127)
DSPDRPWNPPTISPALLVVTEGDNATFTCSFSNTPESFVLNWYRLSPSNQTDKLAAFPEDRIQPGQDCRFRVTQLPNGRDFHMSVVRARRNDSGTYLCGAISLAPKVQIKESLRVELRVTER

SEQ ID NO: 773 - protein, 122 aa, Artificial Sequence
  PD-1 v130 (6-127)
DSPDRPWNPPTFSPALLGVTEGDNATFTCSFSNTSESFVLNWYRMSPSNQPDKLAAFPEDRIQPGQDSRFRVTQLPNGRDYHMSVVGARRNDSGTYLCAAISLAPKVQIKESLWAELRVTER

SEQ ID NO: 774 - protein, 122 aa, Artificial Sequence
  PD-1 v131 (6-127)
DSPDRPWNPPTISPALLVVTEGDNATFTCSFSNTPESFVLNWYRLSPSNQTDKLAAFPEDRIQPGQDSRFRVTQLPNGRDFHMSVVGVRRNDSGTYLCGAISLAPKVQIKESLWAELRVIER

SEQ ID NO: 775 - protein, 122 aa, Artificial Sequence
  PD-1 v132 (6-127)
DSPVRAWDPPTFSPALLVVTEGDNATFTCSFSNTTESFVLNWYRMSPSNQMDKLAAFPEDRNQPGQDCRFRVTQLPNGRDFHMSVVRARLNDSGTYLCAAISLAPKVQIKESLLVELRVTER

SEQ ID NO: 776 - protein, 122 aa, Artificial Sequence
  PD-1 v133 (6-127)
DSPDRPWNPPTISPALLVVAEGDNATFTCSFSNTPESYVLNWYRMSPSNQTDKLAAFPEDRNQPGQDCRFRVTQLPNGRDFHMSVVRARRNDSGTYLCGAISLAPKVQIKESLLVELRVTER

SEQ ID NO: 777 - protein, 122 aa, Artificial Sequence
  PD-1 v134 (6-127)
DSPERPWNPPTISPALLVVTEGDNATFTCSFSNTPESFVLNWYRLSPSNQTDKLAAFPEDRIQPGQDSRFRVTQLPNGRDFHMSMVRARRNDSGAYLCAAISLAPMVQIKESLWVELRVTER

SEQ ID NO: 778 - protein, 101 aa, Artificial Sequence
  CD80 WT IgV
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVT

SEQ ID NO: 779 - protein, 122 aa, Artificial Sequence
  PD-1 v136 (6-127)
DSPDRPWNPPTISPALLVVTEGDNATFTCSFSNTPESFVLNWYRMSPSNQTDKLAAFPEDRNQPGQDCRFRVTQLPNGRDFHMGVVRARLNDSGTYLCGAISLAPKVQIKESLWAELRVIER

SEQ ID NO: 780 - protein, 122 aa, Artificial Sequence
  PD-1 v137 (6-127)
DSPDRPWNPPTISPALLVVTEGDNATFTCSFSNTPESFVLNWYRLSPSNQTDKLAAFPEDRIQPGQDSRFRVTQLPNGRDFHMSVVGVRRNDSGTYLCGAISLAPMVQIKESLQVELRVTER

SEQ ID NO: 781 - protein, 497 aa, Artificial Sequence
  ICOSL/PD-1 Stack 12
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVGGGGSGGGGSGGGGSDSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTERGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 782 - protein, 497 aa, Artificial Sequence
  ICOSL/PD-1 Stack 13
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVGGGGSGGGGSGGGGSDSPDRPWNPPTFSPALLVVTEGDNATFTCSFSNTSESFVLNWYRMSLNNQTDKLAAFPEDRSQPGQDSRFRVTQLPNGRDFHMSVVRARRNDSGTYLCGAISLAPKVQIKDSLWAELRVTERGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 783 - protein, 497 aa, Artificial Sequence
  ICOSL/PD-1 Stack 14
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVGGGGSGGGGSGGGGSDSPDRPWNPPTFSPALLVVTEGDNATFTCSFSNTSESFVLNWYRMSPSNQTDKLAAFPEDRSQPGRDRRFRVTQLPNGRDFHMSVVRARRNDSGTYLCGAISLAPKVQINESLLVELRVTERGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 784 - protein, 497 aa, Artificial Sequence
  ICOSL/PD-1 Stack 15
DTQEKEVRAMVGSDVELSCACPEGSRFDLNDVYVYWQTSESKTVVTYHIPQLSSLEHVDSRYRNRALMSPAGMLRGDFSLRLFNVTPQDEQKFHCLVLSRSLGFQEVLSVEVTLHVAANFSVGGGGSGGGGSGGGGSDSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTERGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 785 - protein, 497 aa, Artificial Sequence
  ICOSL/PD-1 Stack 16
DTQEKEVRAMVGSDVELSCACPEGSRFDLNDVYVYWQTSESKTVVTYHIPQLSSLEHVDSRYRNRALMSPAGMLRGDFSLRLFNVTPQDEQKFHCLVLSRSLGFQEVLSVEVTLHVAANFSVGGGGSGGGGSGGGGSDSPDRPWNPPTFSPALLVVTEGDNATFTCSFSNTSESFVLNWYRMSLNNQTDKLAAFPEDRSQPGQDSRFRVTQLPNGRDFHMSVVRARRNDSGTYLCGAISLAPKVQIKDSLWAELRVTERGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 786 - protein, 497 aa, Artificial Sequence
  ICOSL/PD-1 Stack 17
DTQEKEVRAMVGSDVELSCACPEGSRFDLNDVYVYWQTSESKTVVTYHIPQLSSLEHVDSRYRNRALMSPAGMLRGDFSLRLFNVTPQDEQKFHCLVLSRSLGFQEVLSVEVTLHVAANFSVGGGGSGGGGSGGGGSDSPDRPWNPPTFSPALLVVTEGDNATFTCSFSNTSESFVLNWYRMSPSNQTDKLAAFPEDRSQPGRDRRFRVTQLPNGRDFHMSVVRARRNDSGTYLCGAISLAPKVQINESLLVELRVTERGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 787 - protein, 497 aa, Artificial Sequence
  ICOSL/PD-1 Stack 18
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSDSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTER

SEQ ID NO: 788 - protein, 497 aa, Artificial Sequence
  ICOSL/PD-1 Stack 19
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSDSPDRPWNPPTFSPALLVVTEGDNATFTCSFSNTSESFVLNWYRMSLNNQTDKLAAFPEDRSQPGQDSRFRVTQLPNGRDFHMSVVRARRNDSGTYLCGAISLAPKVQIKDSLWAELRVTER

SEQ ID NO: 789 - protein, 497 aa, Artificial Sequence
  ICOSL/PD-1 Stack 20
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSDSPDRPWNPPTFSPALLVVTEGDNATFTCSFSNTSESFVLNWYRMSPSNQTDKLAAFPEDRSQPGRDRRFRVTQLPNGRDFHMSVVRARRNDSGTYLCGAISLAPKVQINESLLVELRVTER

SEQ ID NO: 790 - protein, 497 aa, Artificial Sequence
  ICOSL/PD-1 Stack 21
DTQEKEVRAMVGSDVELSCACPEGSRFDLNDVYVYWQTSESKTVVTYHIPQLSSLEHVDSRYRNRALMSPAGMLRGDFSLRLFNVTPQDEQKFHCLVLSRSLGFQEVLSVEVTLHVAANFSVGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSDSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTER

SEQ ID NO: 791 - protein, 497 aa, Artificial Sequence
  ICOSL/PD-1 Stack 22
DTQEKEVRAMVGSDVELSCACPEGSRFDLNDVYVYWQTSESKTVVTYHIPQLSSLEHVDSRYRNRALMSPAGMLRGDFSLRLFNVTPQDEQKFHCLVLSRSLGFQEVLSVEVTLHVAANFSVGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSDSPDRPWNPPTFSPALLVVTEGDNATFTCSFSNTSESFVLNWYRMSLNNQTDKLAAFPEDRSQPGQDSRFRVTQLPNGRDFHMSVVRARRNDSGTYLCGAISLAPKVQIKDSLWAELRVTER

SEQ ID NO: 792 - protein, 497 aa, Artificial Sequence
  ICOSL/PD-1 Stack 23
DTQEKEVRAMVGSDVELSCACPEGSRFDLNDVYVYWQTSESKTVVTYHIPQLSSLEHVDSRYRNRALMSPAGMLRGDFSLRLFNVTPQDEQKFHCLVLSRSLGFQEVLSVEVTLHVAANFSVGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSDSPDRPWNPPTFSPALLVVTEGDNATFTCSFSNTSESFVLNWYRMSPSNQTDKLAAFPEDRSQPGRDRRFRVTQLPNGRDFHMSVVRARRNDSGTYLCGAISLAPKVQINESLLVELRVTER

SEQ ID NO: 793 - protein, 497 aa, Artificial Sequence
  ICOSL/PD-1 Stack 24
DSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTERGGGGSGGGGSGGGGSDTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 794 - protein, 497 aa, Artificial Sequence
  ICOSL/PD-1 Stack 25
DSPDRPWNPPTFSPALLVVTEGDNATFTCSFSNTSESFVLNWYRMSLNNQTDKLAAFPEDRSQPGQDSRFRVTQLPNGRDFHMSVVRARRNDSGTYLCGAISLAPKVQIKDSLWAELRVTERGGGGSGGGGSGGGGSDTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 795 - protein, 497 aa, Artificial Sequence
  ICOSL/PD-1 Stack 26
DSPDRPWNPPTFSPALLVVTEGDNATFTCSFSNTSESFVLNWYRMSPSNQTDKLAAFPEDRSQPGRDRRFRVTQLPNGRDFHMSVVRARRNDSGTYLCGAISLAPKVQINESLLVELRVTERGGGGSGGGGSGGGGSDTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 796 - protein, 497 aa, Artificial Sequence
  ICOSL/PD-1 Stack 27
DSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTERGGGGSGGGGSGGGGSDTQEKEVRAMVGSDVELSCACPEGSRFDLNDVYVYWQTSESKTVVTYHIPQLSSLEHVDSRYRNRALMSPAGMLRGDFSLRLFNVTPQDEQKFHCLVLSRSLGFQEVLSVEVTLHVAANFSVGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 797 - protein, 497 aa, Artificial Sequence
  ICOSL/PD-1 Stack 28
DSPDRPWNPPTFSPALLVVTEGDNATFTCSFSNTSESFVLNWYRMSLNNQTDKLAAFPEDRSQPGQDSRFRVTQLPNGRDFHMSVVRARRNDSGTYLCGAISLAPKVQIKDSLWAELRVTERGGGGSGGGGSGGGGSDTQEKEVRAMVGSDVELSCACPEGSRFDLNDVYVYWQTSESKTVVTYHIPQLSSLEHVDSRYRNRALMSPAGMLRGDFSLRLFNVTPQDEQKFHCLVLSRSLGFQEVLSVEVTLHVAANFSVGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 798 - protein, 497 aa, Artificial Sequence
  ICOSL/PD-1 Stack 29
DSPDRPWNPPTFSPALLVVTEGDNATFTCSFSNTSESFVLNWYRMSPSNQTDKLAAFPEDRSQPGRDRRFRVTQLPNGRDFHMSVVRARRNDSGTYLCGAISLAPKVQINESLLVELRVTERGGGGSGGGGSGGGGSDTQEKEVRAMVGSDVELSCACPEGSRFDLNDVYVYWQTSESKTVVTYHIPQLSSLEHVDSRYRNRALMSPAGMLRGDFSLRLFNVTPQDEQKFHCLVLSRSLGFQEVLSVEVTLHVAANFSVGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 799 - protein, 497 aa, Artificial Sequence
  ICOSL/PD-1 Stack 30
DSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTERGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSDTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSV

SEQ ID NO: 800 - protein, 497 aa, Artificial Sequence
  ICOSL/PD-1 Stack 31
DSPDRPWNPPTFSPALLVVTEGDNATFTCSFSNTSESFVLNWYRMSLNNQTDKLAAFPEDRSQPGQDSRFRVTQLPNGRDFHMSVVRARRNDSGTYLCGAISLAPKVQIKDSLWAELRVTERGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSDTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSV

SEQ ID NO: 801 - protein, 497 aa, Artificial Sequence
  ICOSL/PD-1 Stack 32
DSPDRPWNPPTFSPALLVVTEGDNATFTCSFSNTSESFVLNWYRMSPSNQTDKLAAFPEDRSQPGRDRRFRVTQLPNGRDFHMSVVRARRNDSGTYLCGAISLAPKVQINESLLVELRVTERGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSDTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSV

SEQ ID NO: 802 - protein, 497 aa, Artificial Sequence
  ICOSL/PD-1 Stack 33
DSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTERGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSDTQEKEVRAMVGSDVELSCACPEGSRFDLNDVYVYWQTSESKTVVTYHIPQLSSLEHVDSRYRNRALMSPAGMLRGDFSLRLFNVTPQDEQKFHCLVLSRSLGFQEVLSVEVTLHVAANFSV

SEQ ID NO: 803 - protein, 497 aa, Artificial Sequence
  ICOSL/PD-1 Stack 34
DSPDRPWNPPTFSPALLVVTEGDNATFTCSFSNTSESFVLNWYRMSLNNQTDKLAAFPEDRSQPGQDSRFRVTQLPNGRDFHMSVVRARRNDSGTYLCGAISLAPKVQIKDSLWAELRVTERGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSDTQEKEVRAMVGSDVELSCACPEGSRFDLNDVYVYWQTSESKTVVTYHIPQLSSLEHVDSRYRNRALMSPAGMLRGDFSLRLFNVTPQDEQKFHCLVLSRSLGFQEVLSVEVTLHVAANFSV

SEQ ID NO: 804 - protein, 497 aa, Artificial Sequence
  ICOSL/PD-1 Stack 35
DSPDRPWNPPTFSPALLVVTEGDNATFTCSFSNTSESFVLNWYRMSPSNQTDKLAAFPEDRSQPGRDRRFRVTQLPNGRDFHMSVVRARRNDSGTYLCGAISLAPKVQINESLLVELRVTERGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSDTQEKEVRAMVGSDVELSCACPEGSRFDLNDVYVYWQTSESKTVVTYHIPQLSSLEHVDSRYRNRALMSPAGMLRGDFSLRLFNVTPQDEQKFHCLVLSRSLGFQEVLSVEVTLHVAANFSV

SEQ ID NO: 805 - protein, 122 aa, Artificial Sequence
  ICOSL WT IgV
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSV

SEQ ID NO: 806 - protein, 111 aa, Artificial Sequence
  ICOSL WT IgV
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVE

SEQ ID NO: 807 - protein, 122 aa, Artificial Sequence
  ICOSL variant IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSV

SEQ ID NO: 808 - protein, 122 aa, Artificial Sequence
  ICOSL variant IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSV

SEQ ID NO: 809 - protein, 122 aa, Artificial Sequence
  ICOSL variant IgV
DTQEKEVRAMVGSDVELSCACPEGSRFDLNDVYVYWQTSESKTVVTYHIPQLSSLEHVDSRYRNRALMSPAGMLRGDFSLRLFNVTPQDEQKFHCLVLSRSLGFQEVLSVEVTLHVAANFSV

SEQ ID NO: 810 - protein, 122 aa, Artificial Sequence
  ICOSL variant IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSV

SEQ ID NO: 811 - protein, 122 aa, Artificial Sequence
  PD-1 v202 (6-127)
DSPDRPWNPPTFSPALLVVTEGDNATFTCSFSNTSESFVLNWYRMSPSNQTDKLAAFPEDRSQPGQDARFRVTQLPNGRDYHMSVVRARRNDSGTYLCGAITLAPKVQINESLQVELRVTER

SEQ ID NO: 812 - protein, 122 aa, Artificial Sequence
  PD-1 v203 (6-127)
DSPDRPWNPPTFSPALLVVTEGDNATFTCSFSNTSESFVLNWYRMSPSNQTDKLAAFPEDRSQPGQDRRFRVTQLPNGRDYHMSVVRARRNDSGTYLCGGITLAPKVQINESLLVELRVTER

SEQ ID NO: 813 - protein, 122 aa, Artificial Sequence
  PD-1 v204 (6-127)
DSPDRPWNPPTFSPALLVVTEGDNATFTCSFSNTSESFVLNWYRMSPSHQTDKLAAFPEDRSQPEQDPRFRVTQLPNGRDYHMSVVRARRNDSGTYLCGAISLAPKVQIDESLLVELRVTER

SEQ ID NO: 814 - protein, 122 aa, Artificial Sequence
  PD-1 v205 (6-127)
DSPDRPWNPPTFSPALLVVTEGDNATFTCSFSNTSESFVLNWYRMSPSNQTDKLAAFPEDRSQPGQDGRFRVTQLPNGRDYHMSVVRARRNDSGTYLCGAITLAPKVQINESLQVELRVTER

SEQ ID NO: 815 - protein, 122 aa, Artificial Sequence
  PD-1 v206 (6-127)
DSPDRPWNPPTFSPALLVVTEGDNATFTCSFSNTSESFVLNWYRMSPSSQTDKLAAFPEDRSQPGQDGRFRVTQLPNGRDYHMSVVRARRNDSGTYLCGAITLAPKVQIDESLLVELRVTER

SEQ ID NO: 816 - protein, 122 aa, Artificial Sequence
  PD-1 v207 (6-127)
DSPDRPWNPPTFSPALLVVTEGDNATFTCSFSNTSESFVLNWYRMSPSNQTDKLAAFPEDRSQPGQDCRFRVTQLPNGRDYHMSVVRARRNDSGTYLCGAITLAPKVQIDESLWVELRVTER

SEQ ID NO: 817 - protein, 122 aa, Artificial Sequence
  PD-1 v208 (6-127)
DSPDRPWNPPTFSPALLVVTEGDNATFTCSFSNTSESFVLNWYRMSPSNQTDKLAAFPEDRSQPEQDPRFRVTQLPNGRDYHMSVVRARRNDSGTYLCGAITLAPKVQIEESLQVELRVTER

SEQ ID NO: 818 - protein, 122 aa, Artificial Sequence
  PD-1 v209 (6-127)
DSPDRPWNPPTFSPALLVVTEGDNATFTCSFSNTSESFVLNWYRMSPSNQTDKLAAFPEDRSQPGQDGRFRVTQLPNGRDYHMSVVRARRNDSGTYLCGGITLAPKVQIDESLWAELRVTER

SEQ ID NO: 819 - protein, 122 aa, Artificial Sequence
  PD-1 v210 (6-127)
DSPDRPWNPPTFSPALLVVTEGDNATFTCSFSNTSESFVLNWYRMSPSNQTDKLAAFPEDRSQPGQDGRFRVTQLPNGRDYHMSVVRARRNDSGTYLCGAITLAPKVQIDESLLVELRVTER

SEQ ID NO: 820 - protein, 122 aa, Artificial Sequence
  PD-1 v211 (6-127)
DSPDRPWNPPTFSPALLVVTEGDNATFTCSFSNTSESFVLNWYRMSPSNQTDKLAAFPEDRSQPGQDSRFRVTQLPNGRDYHMSVVRARRNDSGTYLCGAITLAPKVQIDESLLVELRVTER

SEQ ID NO: 821 - protein, 122 aa, Artificial Sequence
  PD-1 v212 (6-127)
DSPDRPWNPPTFSPALLVVTEGDNATFTCSFSNTSESFVVNWYRMSPSNQTDKLAAFPEDRSQPGQDGRFRVTQLPNGRDYHMSVVRARRNDSGTYLCAAITLAPKVQINESLWVELRVTER

SEQ ID NO: 822 - protein, 122 aa, Artificial Sequence
  PD-1 v213 (6-127)
DSPDRPWNPPTFSPALLVVTEGDNATFTCSFSNTSESFVLNWYRMSPSNQTDKLAAFPEDRSQPGQDPRFRVTQLPNGRDYHMSVVRARRNDSGTYLCGAITLAPKVQIDESLQVELRVTER

SEQ ID NO: 823 - protein, 122 aa, Artificial Sequence
  PD-1 v214 (6-127)
DSPDRPWNPPTFSPALLVVTEGDNATFTCSFSNTSESFVLNWYRMSPSNQTDKLAAFPEDRSQPGQDSRFRVTQLPNGRDYHMSVVRARRNDSGTYLCGAITLAPKVQIEESLQVELRVTER

SEQ ID NO: 824 - protein, 122 aa, Artificial Sequence
  PD-1 v215 (6-127)
DSPDRPWNPPTFSPALLVVTEGDNATFTCSFSNTSESFVLNWYRMSPSNQTDKLAAFPEDRSQPGQDSRFRVTQLPNGRDYHMSVVRARRNDSGTYLCTAITLAPKVQIEESLWVELRVTER

SEQ ID NO: 825 - protein, 122 aa, Artificial Sequence
  PD-1 v216 (6-127)
DSPDRPWNPPTFSPALLVVTEGDNATFTCSFSNTSESFVLNWYRMSPSNQTDKLAAFPEDRSQPGQDRRFRVTQLPNGRDYHMSVVRARRNDSGTYLCGAITLAPRVQIDESLRVELRVTER

SEQ ID NO: 826 - protein, 122 aa, Artificial Sequence
  PD-1 v217 (6-127)
DSPDRPWNLPTFSPALLVVTEGDNATFTCSFSNTSESFVLNWYRMSPSNQTDKLAAFPEDRSQPGQDGRFRVTQLPNGRDYHMSVVRARRNDSGTYLCGAITLAPKVQIDESLLVELRVTER

SEQ ID NO: 827 - protein, 122 aa, Artificial Sequence
  PD-1 v218 (6-127)
DSPDRPWNPPTFSPALLVVTEGDNATFTCSFSNTSESFVLNWYRMSPSNQTDKLAAFPEDRSQPEQDCRFRVTQLPNGRDYHMSVVRARRNDSGTYLCGAITLAPKVQIDESLLVELRVTER

SEQ ID NO: 828 - protein, 122 aa, Artificial Sequence
  PD-1 v219 (6-127)
DSPDRPWNPPTFSPALLVVTEGDNATFTCSFSNTSESFVLNWYRMSPSNQTDKLAAFPEDRSQPGQDGRFRVTQLPNGRDYHMSVVRARRNDSGTYLCVAITLAPKVQINESLLVELRVTER

SEQ ID NO: 829 - protein, 122 aa, Artificial Sequence
  PD-1 v220 (6-127)
DSPDRPWNPPTFSPALLVVTEGDNATFTCSFSNTSESFVLNWYRMSPSNQTDKLAAFPEDRSQPGQDSRFRVTQLPNGRDYHMSVVRARRNDSGTYLCSAITFAPKVQIDESLLVELRVTER

SEQ ID NO: 830 - protein, 122 aa, Artificial Sequence
  PD-1 v221 (6-127)
DSPDRPWNPPTFSPALLVVTEGDNATFTCSFSNTSESFVLNWYRMSPSNQTDKLAAFPEDRSQPGQDSRFRVTQLPNGRDYHMSVVRARRNDSGTYLCGAITLAPKVQIDESLRVELRVTER

SEQ ID NO: 831 - protein, 122 aa, Artificial Sequence
  PD-1 v222 (6-127)
DSPDRPWNPPTFSPALLVVTEGDNATFTCSFSNTSESFVLNWYRMSPSNQTDKLAAFPEDRSQPGQDRRFRVTQLPNGRDYHMSVVRARRNDSGTYLCGAITLAPKVQIDESLLVELRVTER

SEQ ID NO: 832 - protein, 122 aa, Artificial Sequence
  PD-1 v223 (6-127)
DSPDRPWNPPTFSPALLVVTEGDNATFTCSFSNTSESFVLNWYRMSPSNQTDKLAAFPEDRSQPGQDSRFRVTQLPNGRDYHMSVVRARRNDSGTYLCGAITLAPKVRIDESLLVELRVTER

SEQ ID NO: 833 - protein, 122 aa, Artificial Sequence
  PD-1 v224 (6-127)
DSPDRPWNPPTFSPALLVVTEGDNATFTCSFSNTSESFVLNWYRMSPSNQTDKLAAFPEDRSQPGQDSRFRVTQLPNGRDYHMSVARARRNDSGTYLCGAITLAPKVQIDESLLVELRVTER

SEQ ID NO: 834 - protein, 122 aa, Artificial Sequence
  PD-1 v225 (6-127)
DSPDRPWNPPTFSPALLVVTEGDNATFTCSFSNTSESFVLNWYRMSPSNQTDKLAAFPEDRSQPEQDPRFRVTQLPNGRDYHMSVVRARRNDSGTYLCGGITLAPKVQIDESLQVELRVTER

SEQ ID NO: 835 - protein, 122 aa, Artificial Sequence
  PD-1 v226 (6-127)
DSPDRPWNPPTFSPALLVVTEGDNATFTCSFSNTSESFVLNWYRMSPSNQTDKLAAFPEDRSQPGQDGRFRVTQLPNGRDYHMSVVRARRNDSGTYLCGGITLAPKVQIDESLLVELRVTER

SEQ ID NO: 836 - protein, 122 aa, Artificial Sequence
  PD-1 v227 (6-127)
DSPDRPWNPPTFSPALLVVTEGDNATFTCSFSNTSESFVLNWYRMSPSNQTDKLAAFPEDRSQPGQDGRFRVTQLPNGRDYHMSVVRARRNDSGTYLCGGITLAPKVRIDESLLVELRVTER

SEQ ID NO: 837 - protein, 122 aa, Artificial Sequence
  PD-1 v228 (6-127)
DSPDRPWNPPTFSPALLVVTEGDNATFTCSFSNTSESFVLNWYRMSPSNQTDKLAAFPEDRSQPGQDCRFRVTQLPNGRDYHMSVVRARRNDSGTYLCGAITLAPKVQIDESLQVELRVTER

SEQ ID NO: 838 - protein, 122 aa, Artificial Sequence
  PD-1 v229 (6-127)
DSPDRPWNPPTFSPALLVVTEGDNATFTCSFSNTSESFVLNWYRMSPSNQTDKLAAFPEDRSQPGQDRRFRVTQLPNGRDYHMSVVRARRNDSGTYLCGAITLAPKVQINESLLVELRVTER

SEQ ID NO: 839 - protein, 122 aa, Artificial Sequence
  PD-1 v230 (6-127)
DSPDRPWNPPTFSPALLVVTEGDNATFTCSFSNTSESFVLNWYRMSPSNQTDKLAAFPEDRSQPGQDARFRVTQLPNGRDYHMSVVRARRNDSGTYLCGAITLAPKVRIEESLQVELRVTER

SEQ ID NO: 840 - protein, 122 aa, Artificial Sequence
  PD-1 v231 (6-127)
DSPDRPWNPPTFSPALLVVTEGDNATFTCSFSNTSESFVLNWYRMSPSNQTDKLAAFPEDRSQPGQDRRFRVTQLPNGRDYHMSVVRARRNDSGTYLCGAITLAPKVQIDESLQVELRVTER

SEQ ID NO: 841 - protein, 122 aa, Artificial Sequence
  PD-1 v232 (6-127)
DSPDRPWNPPTFSPALLVVTEGDNATFTCSFSNTSESFVLNWYRMSPSNQTDKLAAFPEDRSQPGQDGRFRVTQLPNGRDYHMSVVRARRNDSGTYLCGAISLAPKVQIDESLWVELRVTER

SEQ ID NO: 842 - protein, 122 aa, Artificial Sequence
  PD-1 v233 (6-127)
DSPDRPWNPPTFSPALLVVTEGDNATFTCSFSNTSESFVLNWYRMSPSNQTDKLAAFPEDRSQPGQDPRFRVTQLPNGRDYHMSVVRARRNDSGTYLCGGITLAPKVRIDESLLVELRVTER

SEQ ID NO: 843 - protein, 122 aa, Artificial Sequence
  PD-1 v234 (6-127)
DSPDRPWNPPTFSPALLVVTEGDNATFTCSFSNTSESFVLNWYRMSPSNQTDKLAAFPEDRSQPGQDRRFRVTQLPNGRDYHMSVVRARRNDSGTYLCGGITLAPKVQIDESLLVELRVTER

SEQ ID NO: 844 - protein, 122 aa, Artificial Sequence
  PD-1 v235 (6-127)
DSPDRPWNPPTFSPALLVVTEGDNATFTCSFSNTSESFVLNWYRMSPSNQTDKLAAFPEDRSQPGQDARFRVTQLPNGRDYHMSVVRARRNDSGTYLCGAITLAPKVQIDESLLVELRVTER

SEQ ID NO: 845 - protein, 122 aa, Artificial Sequence
  PD-1 v236 (6-127)
DSPDRPWNPPTFSPALLVVTEGDNATFTCSFSNTSESFVLNWYRMSPSNQTDKLAAFPEDRSQSGQDRRFRVTQLPNGRDYHMSVVRARRNDSGTYLCGAITLAPKVQIDESLWVELRVTER

SEQ ID NO: 846 - protein, 122 aa, Artificial Sequence
  PD-1 v237 (6-127)
DSPDRPWNPPTFSPALLVVTEGDNATFTCSFSNTSESFVLNWYRMSPSNQTDKLAAFPEDRSQPGQDSRFRVTQLPNGRDYHMSVVRARRNDSGTYLCSAITLAPKVQIEESLWVELRVTER

SEQ ID NO: 847 - protein, 122 aa, Artificial Sequence
  PD-1 v238 (6-127)
DSPDRPWNPPTFSPALLVVTEGDNATFTCSFSNTSESFVLNWYRMSPSNQTDKLAAFPEDRSRPGQDSRFRVTQLPNGRDYHMSVVRARRNDSGTYLCGAITLAPKVQIDESLQVELRVTER

SEQ ID NO: 848 - protein, 122 aa, Artificial Sequence
  PD-1 v239 (6-127)
DSPDRPWNPPTFSPALLVVTEGDNATFTCSFSNTSESFVLNWYRMSPSNQTDKLAAFPEDRSQPGQDRRFRVTQLPNGRDYHMSVVRARRNDSGTYLCGAITLAPKVQINESLQVELRVTER

SEQ ID NO: 849 - protein, 122 aa, Artificial Sequence
  PD-1 v240 (6-127)
DSPDRPWNPPTFSPALLVVTEGDNATFTCSFSNTSESFVLNWYRMSPSNQTDKLAAFPEDRSQPEQDRRFRVTQLPNGRDYHMSVVRARRNDSGTYLCGAITLAPKVQINESLQVELRVTER

SEQ ID NO: 850 - protein, 122 aa, Artificial Sequence
  PD-1 v241 (6-127)
DSPDRPWNPPTFSPALLVVTEGDNATFTCSFSNTSESFVLNWYRMSPSNQTDKLAAFPEDRSQPGQDSRFRVTQLPNGRDYHMSVVRARRNDSGTYLCGAITLAPKVQIDESLWVELRVTER

SEQ ID NO: 851 - protein, 122 aa, Artificial Sequence
  PD-1 v242 (6-127)
DSPDRPWNPPTFSPALLVVTEGDNATFTCSFSNTSESFVLNWYRMSPSNQTDKLAAFPEDRSQPEQDCRFRVTQLPNGRDYHMSVVRARRNDSGTYLCTALTTAPKVQINESLLVELRVTER

SEQ ID NO: 852 - protein, 122 aa, Artificial Sequence
  PD-1 v243 (6-127)
DSPDRPWNPPTFSPALLVVTEGDNATFTCSFSNTSESFVLNWYRMSPSNQTDKLAAFPEDRSQPGQDHRFRVTQLPNGRDYHMSVVRARRNDSGTYLCGGITLAPKVQIDESLLVELRVTER

SEQ ID NO: 853 - protein, 122 aa, Artificial Sequence
  PD-1 v244 (6-127)
DSPDRPWNPPTFSPALLVVTEGDNATFTCSFSNTSESFVLNWYRMSPSNQTDKLAAFPEDRSQPEQDPRFRVTQLPNGRDYHMSVVRARRNDSGTYLCGCITLAPKVQIDESLLVELRVTER

SEQ ID NO: 854 - protein, 122 aa, Artificial Sequence
  PD-1 v245 (6-127)
DSPDRPWNPPTFSPALLVVTEGDNATFTCSFSNTSESFVLNWYRMSPSNQTDKLAAFPEDRSQPEQDPRFRVTQLPNGRDYHMSVVRARRNDSGTYLCGAITLAPKVQIDESLQVELRVTER

SEQ ID NO: 855 - protein, 122 aa, Artificial Sequence
  PD-1 v246 (6-127)
DSPDRPWNPPTFSPALLVVTEGDNATFTCSFSNTSESFVLNWYRMSPSNQTDKLAAFPEDRSQPGQDSRFRVTQLPNGRDYHMSVVRARRNDSGTYLCGAITLAPRVQIEESLLVELRVTER

SEQ ID NO: 856 - protein, 122 aa, Artificial Sequence
  PD-1 v247 (6-127)
DSPDRPWNPPTFSPALLVVTEGDNATFTCSFSNTSESFVLNWYRMSPSNQTDKLAAFPEDRSQPGQDRRFRVTQLPNGRGYHMSVVRARRNDSGTYLCGGITLAPKVQIDESLQVELRVTER

SEQ ID NO: 857 - protein, 122 aa, Artificial Sequence
  PD-1 v248 (6-127)
DSPDRPWNPPTFSPALLVVTEGDNATFTCSFSNTSESFVLNWYRMSPSNQTDKLAAFPEDRSQPGQDRRFRVTQLPNGRDYHMSVVRARRNDSGTYLCGAITLAPKVQIEESLWVELRVTER

SEQ ID NO: 858 - protein, 122 aa, Artificial Sequence
  PD-1 v249 (6-127)
DSPDRPWNPPTFSPALLVVTEGDNATFTCSFSNTSESFVLNWYRMSPSSQTDKLAAFPEDRSQPGQDGRFRVTQLPNGRDYHMSVVRARRNDSGTYLCGAITLAPKVQIEESLQVELRVTER

SEQ ID NO: 859 - protein, 122 aa, Artificial Sequence
  PD-1 v250 (6-127)
DSPDRPWNPPTFSPALLVVTEGDNATFTCSFSNTSESFVLNWYRMSPSNQTDKLAAFPEDRSQPGQDSRFRVTQLPNGRDYHMSVVRARRNDSGTYLCSAITLAPKVQINESLLVELRVTER

SEQ ID NO: 860 - protein, 122 aa, Artificial Sequence
  PD-1 v251 (6-127)
DSPDRPWNPPTLSPALLVVTEGDNATFTCSFSNTSESFVLNWYRMSPSNQTDKLAAFPEDRSQPGRDGRFRVTQLPNGRDYHMSVVRARRNDSGTYLCGGITLAPKVQIDESLLVELRVTER

SEQ ID NO: 861 - protein, 122 aa, Artificial Sequence
  PD-1 v252 (6-127)
DSPDRPWNPPTFSPALLVVTEGDNATFTCSFSNTSESFVLNWYRMSPSNQTDKLAAFPEDRSQPGQDGRFRVTQLPNGRDYHMSVVRARRNDSGTYLCGAITLAPKVQIEESLWVELRVTER

SEQ ID NO: 862 - protein, 122 aa, Artificial Sequence
  PD-1 v253 (6-127)
DSPDRPWNPPTFSPALLVVTEGDNATFTCSFSNTSESFVLNWYRMSPSNQTDKLAAFPEDRSQPEQDGRFRVTQLPNGRDYHMSVVRARRNDSGTYLCGCITLAPKVQIEESLLVELRVTER

SEQ ID NO: 863 - protein, 122 aa, Artificial Sequence
  PD-1 v254 (6-127)
DSPDRPWNPPTFSPALLVVTEGDNATFTCSFSNTSESFVLNWYRMSPSNQTDKLAAFPEDRSQPGQDGRFRVTQLPNGRDYHMSVVRARRNDSGTYLCAAITLAPKVQIDESLWVELRVTER

SEQ ID NO: 864 - protein, 122 aa, Artificial Sequence
  PD-1 v255 (6-127)
DSPDRPWNPPTFSPALLVVTEGDNATFTCSFSNTSESFVLNWYRMSPSNQTDKLAAFPEDRSQPGQDSRFRVTQLPNGRDYHMSVVRARRNDSGTYLCGAITLAPKVQINESLRVELRVTER

SEQ ID NO: 865 - protein, 122 aa, Artificial Sequence
  PD-1 v256 (6-127)
DSPDRPWNPPTFSPALLVVTEGDNATFTCSFSNTSESFVLNWYRMSPSNQTDKLAAFPEDRSQPGQDPRFRVTQLPNGRDYHMSVVRARRNDSGTYLCGAITLAPKVQINESLLVELRVTER

SEQ ID NO: 866 - protein, 122 aa, Artificial Sequence
  PD-1 v257 (6-127)
DSPDRPRNPPTFSPALLVVTEGDNATFTCSFSNTSESFVLNWYRMSPSNQTDKLAAFPEDRSQPGQDCRFRVTQLPNGRDYHMSVVRARRNDSGTYLCGAITLAPKVQIDESLQVELRVTER

SEQ ID NO: 867 - protein, 122 aa, Artificial Sequence
  PD-1 v258 (6-127)
DSPDRPWNPPTFSPALLVVTEGDNATFTCSFSNTSESFVLNWYRMSPSNQTDKLAAFPEDRSQPEQDGRFRVTQLPNGRDYHMSVVRARRNDSGTYLCGLISLAPKVQINESLQVELRVTER

SEQ ID NO: 868 - protein, 122 aa, Artificial Sequence
  PD-1 v259 (6-127)
DSPDRPWNPPTFSPALLVVTEGDNATFTCSFSNTSESFVLNWYRMSPSNQTDKLAAFPEDRSQPGQDCRFRVTQLPNGRDYHMSVVRARRNDSGTYLCGAITLAPKVQINESLWVELRVTER

SEQ ID NO: 869 - protein, 150 aa, Artificial Sequence
  PD-1 v202 (1-150)
PGWFLDSPDRPWNPPTFSPALLVVTEGDNATFTCSFSNTSESFVLNWYRMSPSNQTDKLAAFPEDRSQPGQDARFRVTQLPNGRDYHMSVVRARRNDSGTYLCGAITLAPKVQINESLQVELRVTERRAEVPTAHPSPSPRPAGQFQTLV

SEQ ID NO: 870 - protein, 150 aa, Artificial Sequence
  PD-1 v203 (1-150)
PGWFLDSPDRPWNPPTFSPALLVVTEGDNATFTCSFSNTSESFVLNWYRMSPSNQTDKLAAFPEDRSQPGQDRRFRVTQLPNGRDYHMSVVRARRNDSGTYLCGGITLAPKVQINESLLVELRVTERRAEVPTAHPSPSPRPAGQFQTLV

SEQ ID NO: 871 - protein, 150 aa, Artificial Sequence
  PD-1 v204 (1-150)
PGWFLDSPDRPWNPPTFSPALLVVTEGDNATFTCSFSNTSESFVLNWYRMSPSHQTDKLAAFPEDRSQPEQDPRFRVTQLPNGRDYHMSVVRARRNDSGTYLCGAISLAPKVQIDESLLVELRVTERRAEVPTAHPSPSPRPAGQFQTLV

SEQ ID NO: 872 - protein, 150 aa, Artificial Sequence
  PD-1 v205 (1-150)
PGWFLDSPDRPWNPPTFSPALLVVTEGDNATFTCSFSNTSESFVLNWYRMSPSNQTDKLAAFPEDRSQPGQDGRFRVTQLPNGRDYHMSVVRARRNDSGTYLCGAITLAPKVQINESLQVELRVTERRAEVPTAHPSPSPRPAGQFQTLV

SEQ ID NO: 873 - protein, 150 aa, Artificial Sequence
  PD-1 v206 (1-150)
PGWFLDSPDRPWNPPTFSPALLVVTEGDNATFTCSFSNTSESFVLNWYRMSPSSQTDKLAAFPEDRSQPGQDGRFRVTQLPNGRDYHMSVVRARRNDSGTYLCGAITLAPKVQIDESLLVELRVTERRAEVPTAHPSPSPRPAGQFQTLV

SEQ ID NO: 874 - protein, 150 aa, Artificial Sequence
  PD-1 v207 (1-150)
PGWFLDSPDRPWNPPTFSPALLVVTEGDNATFTCSFSNTSESFVLNWYRMSPSNQTDKLAAFPEDRSQPGQDCRFRVTQLPNGRDYHMSVVRARRNDSGTYLCGAITLAPKVQIDESLWVELRVTERRAEVPTAHPSPSPRPAGQFQTLV

SEQ ID NO: 875 - protein, 150 aa, Artificial Sequence
  PD-1 v208 (1-150)
PGWFLDSPDRPWNPPTFSPALLVVTEGDNATFTCSFSNTSESFVLNWYRMSPSNQTDKLAAFPEDRSQPEQDPRFRVTQLPNGRDYHMSVVRARRNDSGTYLCGAITLAPKVQIEESLQVELRVTERRAEVPTAHPSPSPRPAGQFQTLV

SEQ ID NO: 876 - protein, 150 aa, Artificial Sequence
  PD-1 v209 (1-150)
PGWFLDSPDRPWNPPTFSPALLVVTEGDNATFTCSFSNTSESFVLNWYRMSPSNQTDKLAAFPEDRSQPGQDGRFRVTQLPNGRDYHMSVVRARRNDSGTYLCGGITLAPKVQIDESLWAELRVTERRAEVPTAHPSPSPRPAGQFQTLV

SEQ ID NO: 877 - protein, 150 aa, Artificial Sequence
  PD-1 v210 (1-150)
PGWFLDSPDRPWNPPTFSPALLVVTEGDNATFTCSFSNTSESFVLNWYRMSPSNQTDKLAAFPEDRSQPGQDGRFRVTQLPNGRDYHMSVVRARRNDSGTYLCGAITLAPKVQIDESLLVELRVTERRAEVPTAHPSPSPRPAGQFQTLV

SEQ ID NO: 878 - protein, 150 aa, Artificial Sequence
  PD-1 v211 (1-150)
PGWFLDSPDRPWNPPTFSPALLVVTEGDNATFTCSFSNTSESFVLNWYRMSPSNQTDKLAAFPEDRSQPGQDSRFRVTQLPNGRDYHMSVVRARRNDSGTYLCGAITLAPKVQIDESLLVELRVTERRAEVPTAHPSPSPRPAGQFQTLV

SEQ ID NO: 879 - protein, 150 aa, Artificial Sequence
  PD-1 v212 (1-150)
PGWFLDSPDRPWNPPTFSPALLVVTEGDNATFTCSFSNTSESFVVNWYRMSPSNQTDKLAAFPEDRSQPGQDGRFRVTQLPNGRDYHMSVVRARRNDSGTYLCAAITLAPKVQINESLWVELRVTERRAEVPTAHPSPSPRPAGQFQTLV

SEQ ID NO: 880 - protein, 150 aa, Artificial Sequence
  PD-1 v213 (1-150)
PGWFLDSPDRPWNPPTFSPALLVVTEGDNATFTCSFSNTSESFVLNWYRMSPSNQTDKLAAFPEDRSQPGQDPRFRVTQLPNGRDYHMSVVRARRNDSGTYLCGAITLAPKVQIDESLQVELRVTERRAEVPTAHPSPSPRPAGQFQTLV

SEQ ID NO: 881 - protein, 150 aa, Artificial Sequence
  PD-1 v214 (1-150)
PGWFLDSPDRPWNPPTFSPALLVVTEGDNATFTCSFSNTSESFVLNWYRMSPSNQTDKLAAFPEDRSQPGQDSRFRVTQLPNGRDYHMSVVRARRNDSGTYLCGAITLAPKVQIEESLQVELRVTERRAEVPTAHPSPSPRPAGQFQTLV

SEQ ID NO: 882 - protein, 150 aa, Artificial Sequence
  PD-1 v215 (1-150)
PGWFLDSPDRPWNPPTFSPALLVVTEGDNATFTCSFSNTSESFVLNWYRMSPSNQTDKLAAFPEDRSQPGQDSRFRVTQLPNGRDYHMSVVRARRNDSGTYLCTAITLAPKVQIEESLWVELRVTERRAEVPTAHPSPSPRPAGQFQTLV

SEQ ID NO: 883 - protein, 150 aa, Artificial Sequence
  PD-1 v216 (1-150)
PGWFLDSPDRPWNPPTFSPALLVVTEGDNATFTCSFSNTSESFVLNWYRMSPSNQTDKLAAFPEDRSQPGQDRRFRVTQLPNGRDYHMSVVRARRNDSGTYLCGAITLAPRVQIDESLRVELRVTERRAEVPTAHPSPSPRPAGQFQTLV

SEQ ID NO: 884 - protein, 150 aa, Artificial Sequence
  PD-1 v217 (1-150)
PGWFLDSPDRPWNLPTFSPALLVVTEGDNATFTCSFSNTSESFVLNWYRMSPSNQTDKLAAFPEDRSQPGQDGRFRVTQLPNGRDYHMSVVRARRNDSGTYLCGAITLAPKVQIDESLLVELRVTERRAEVPTAHPSPSPRPAGQFQTLV

SEQ ID NO: 885 - protein, 150 aa, Artificial Sequence
  PD-1 v218 (1-150)
PGWFLDSPDRPWNPPTFSPALLVVTEGDNATFTCSFSNTSESFVLNWYRMSPSNQTDKLAAFPEDRSQPEQDCRFRVTQLPNGRDYHMSVVRARRNDSGTYLCGAITLAPKVQIDESLLVELRVTERRAEVPTAHPSPSPRPAGQFQTLV

SEQ ID NO: 886 - protein, 150 aa, Artificial Sequence
  PD-1 v219 (1-150)
PGWFLDSPDRPWNPPTFSPALLVVTEGDNATFTCSFSNTSESFVLNWYRMSPSNQTDKLAAFPEDRSQPGQDGRFRVTQLPNGRDYHMSVVRARRNDSGTYLCVAITLAPKVQINESLLVELRVTERRAEVPTAHPSPSPRPAGQFQTLV

SEQ ID NO: 887 - protein, 150 aa, Artificial Sequence
  PD-1 v220 (1-150)
PGWFLDSPDRPWNPPTFSPALLVVTEGDNATFTCSFSNTSESFVLNWYRMSPSNQTDKLAAFPEDRSQPGQDSRFRVTQLPNGRDYHMSVVRARRNDSGTYLCSAITFAPKVQIDESLLVELRVTERRAEVPTAHPSPSPRPAGQFQTLV

SEQ ID NO: 888 - protein, 150 aa, Artificial Sequence
  PD-1 v221 (1-150)
PGWFLDSPDRPWNPPTFSPALLVVTEGDNATFTCSFSNTSESFVLNWYRMSPSNQTDKLAAFPEDRSQPGQDSRFRVTQLPNGRDYHMSVVRARRNDSGTYLCGAITLAPKVQIDESLRVELRVTERRAEVPTAHPSPSPRPAGQFQTLV

SEQ ID NO: 889 - protein, 150 aa, Artificial Sequence
  PD-1 v222 (1-150)
PGWFLDSPDRPWNPPTFSPALLVVTEGDNATFTCSFSNTSESFVLNWYRMSPSNQTDKLAAFPEDRSQPGQDRRFRVTQLPNGRDYHMSVVRARRNDSGTYLCGAITLAPKVQIDESLLVELRVTERRAEVPTAHPSPSPRPAGQFQTLV

SEQ ID NO: 890 - protein, 150 aa, Artificial Sequence
  PD-1 v223 (1-150)
PGWFLDSPDRPWNPPTFSPALLVVTEGDNATFTCSFSNTSESFVLNWYRMSPSNQTDKLAAFPEDRSQPGQDSRFRVTQLPNGRDYHMSVVRARRNDSGTYLCGAITLAPKVRIDESLLVELRVTERRAEVPTAHPSPSPRPAGQFQTLV

SEQ ID NO: 891 - protein, 150 aa, Artificial Sequence
  PD-1 v224 (1-150)
PGWFLDSPDRPWNPPTFSPALLVVTEGDNATFTCSFSNTSESFVLNWYRMSPSNQTDKLAAFPEDRSQPGQDSRFRVTQLPNGRDYHMSVARARRNDSGTYLCGAITLAPKVQIDESLLVELRVTERRAEVPTAHPSPSPRPAGQFQTLV

SEQ ID NO: 892 - protein, 150 aa, Artificial Sequence
  PD-1 v225 (1-150)
PGWFLDSPDRPWNPPTFSPALLVVTEGDNATFTCSFSNTSESFVLNWYRMSPSNQTDKLAAFPEDRSQPEQDPRFRVTQLPNGRDYHMSVVRARRNDSGTYLCGGITLAPKVQIDESLQVELRVTERRAEVPTAHPSPSPRPAGQFQTLV

SEQ ID NO: 893 - protein, 150 aa, Artificial Sequence
  PD-1 v226 (1-150)
PGWFLDSPDRPWNPPTFSPALLVVTEGDNATFTCSFSNTSESFVLNWYRMSPSNQTDKLAAFPEDRSQPGQDGRFRVTQLPNGRDYHMSVVRARRNDSGTYLCGGITLAPKVQIDESLLVELRVTERRAEVPTAHPSPSPRPAGQFQTLV

SEQ ID NO: 894 - protein, 150 aa, Artificial Sequence
  PD-1 v227 (1-150)
PGWFLDSPDRPWNPPTFSPALLVVTEGDNATFTCSFSNTSESFVLNWYRMSPSNQTDKLAAFPEDRSQPGQDGRFRVTQLPNGRDYHMSVVRARRNDSGTYLCGGITLAPKVRIDESLLVELRVTERRAEVPTAHPSPSPRPAGQFQTLV

SEQ ID NO: 895 - protein, 150 aa, Artificial Sequence
  PD-1 v228 (1-150)
PGWFLDSPDRPWNPPTFSPALLVVTEGDNATFTCSFSNTSESFVLNWYRMSPSNQTDKLAAFPEDRSQPGQDCRFRVTQLPNGRDYHMSVVRARRNDSGTYLCGAITLAPKVQIDESLQVELRVTERRAEVPTAHPSPSPRPAGQFQTLV

SEQ ID NO: 896 - protein, 150 aa, Artificial Sequence
  PD-1 v229 (1-150)
PGWFLDSPDRPWNPPTFSPALLVVTEGDNATFTCSFSNTSESFVLNWYRMSPSNQTDKLAAFPEDRSQPGQDRRFRVTQLPNGRDYHMSVVRARRNDSGTYLCGAITLAPKVQINESLLVELRVTERRAEVPTAHPSPSPRPAGQFQTLV

SEQ ID NO: 897 - protein, 150 aa, Artificial Sequence
  PD-1 v230 (1-150)
PGWFLDSPDRPWNPPTFSPALLVVTEGDNATFTCSFSNTSESFVLNWYRMSPSNQTDKLAAFPEDRSQPGQDARFRVTQLPNGRDYHMSVVRARRNDSGTYLCGAITLAPKVRIEESLQVELRVTERRAEVPTAHPSPSPRPAGQFQTLV

SEQ ID NO: 898 - protein, 150 aa, Artificial Sequence
  PD-1 v231 (1-150)
PGWFLDSPDRPWNPPTFSPALLVVTEGDNATFTCSFSNTSESFVLNWYRMSPSNQTDKLAAFPEDRSQPGQDRRFRVTQLPNGRDYHMSVVRARRNDSGTYLCGAITLAPKVQIDESLQVELRVTERRAEVPTAHPSPSPRPAGQFQTLV

SEQ ID NO: 899 - protein, 150 aa, Artificial Sequence
  PD-1 v232 (1-150)
PGWFLDSPDRPWNPPTFSPALLVVTEGDNATFTCSFSNTSESFVLNWYRMSPSNQTDKLAAFPEDRSQPGQDGRFRVTQLPNGRDYHMSVVRARRNDSGTYLCGAISLAPKVQIDESLWVELRVTERRAEVPTAHPSPSPRPAGQFQTLV

SEQ ID NO: 900 - protein, 150 aa, Artificial Sequence
  PD-1 v233 (1-150)
PGWFLDSPDRPWNPPTFSPALLVVTEGDNATFTCSFSNTSESFVLNWYRMSPSNQTDKLAAFPEDRSQPGQDPRFRVTQLPNGRDYHMSVVRARRNDSGTYLCGGITLAPKVRIDESLLVELRVTERRAEVPTAHPSPSPRPAGQFQTLV

SEQ ID NO: 901 - protein, 150 aa, Artificial Sequence
  PD-1 v234 (1-150)
PGWFLDSPDRPWNPPTFSPALLVVTEGDNATFTCSFSNTSESFVLNWYRMSPSNQTDKLAAFPEDRSQPGQDRRFRVTQLPNGRDYHMSVVRARRNDSGTYLCGGITLAPKVQIDESLLVELRVTERRAEVPTAHPSPSPRPAGQFQTLV

SEQ ID NO: 902 - protein, 150 aa, Artificial Sequence
  PD-1 v235 (1-150)
PGWFLDSPDRPWNPPTFSPALLVVTEGDNATFTCSFSNTSESFVLNWYRMSPSNQTDKLAAFPEDRSQPGQDARFRVTQLPNGRDYHMSVVRARRNDSGTYLCGAITLAPKVQIDESLLVELRVTERRAEVPTAHPSPSPRPAGQFQTLV

SEQ ID NO: 903 - protein, 150 aa, Artificial Sequence
  PD-1 v236 (1-150)
PGWFLDSPDRPWNPPTFSPALLVVTEGDNATFTCSFSNTSESFVLNWYRMSPSNQTDKLAAFPEDRSQSGQDRRFRVTQLPNGRDYHMSVVRARRNDSGTYLCGAITLAPKVQIDESLWVELRVTERRAEVPTAHPSPSPRPAGQFQTLV

SEQ ID NO: 904 - protein, 150 aa, Artificial Sequence
  PD-1 v237 (1-150)
PGWFLDSPDRPWNPPTFSPALLVVTEGDNATFTCSFSNTSESFVLNWYRMSPSNQTDKLAAFPEDRSQPGQDSRFRVTQLPNGRDYHMSVVRARRNDSGTYLCSAITLAPKVQIEESLWVELRVTERRAEVPTAHPSPSPRPAGQFQTLV

SEQ ID NO: 905 - protein, 150 aa, Artificial Sequence
  PD-1 v238 (1-150)
PGWFLDSPDRPWNPPTFSPALLVVTEGDNATFTCSFSNTSESFVLNWYRMSPSNQTDKLAAFPEDRSRPGQDSRFRVTQLPNGRDYHMSVVRARRNDSGTYLCGAITLAPKVQIDESLQVELRVTERRAEVPTAHPSPSPRPAGQFQTLV

SEQ ID NO: 906 - protein, 150 aa, Artificial Sequence
  PD-1 v239 (1-150)
PGWFLDSPDRPWNPPTFSPALLVVTEGDNATFTCSFSNTSESFVLNWYRMSPSNQTDKLAAFPEDRSQPGQDRRFRVTQLPNGRDYHMSVVRARRNDSGTYLCGAITLAPKVQINESLQVELRVTERRAEVPTAHPSPSPRPAGQFQTLV

SEQ ID NO: 907 - protein, 150 aa, Artificial Sequence
  PD-1 v240 (1-150)
PGWFLDSPDRPWNPPTFSPALLVVTEGDNATFTCSFSNTSESFVLNWYRMSPSNQTDKLAAFPEDRSQPEQDRRFRVTQLPNGRDYHMSVVRARRNDSGTYLCGAITLAPKVQINESLQVELRVTERRAEVPTAHPSPSPRPAGQFQTLV

SEQ ID NO: 908 - protein, 150 aa, Artificial Sequence
  PD-1 v241 (1-150)
PGWFLDSPDRPWNPPTFSPALLVVTEGDNATFTCSFSNTSESFVLNWYRMSPSNQTDKLAAFPEDRSQPGQDSRFRVTQLPNGRDYHMSVVRARRNDSGTYLCGAITLAPKVQIDESLWVELRVTERRAEVPTAHPSPSPRPAGQFQTLV

SEQ ID NO: 909 - protein, 150 aa, Artificial Sequence
  PD-1 v242 (1-150)
PGWFLDSPDRPWNPPTFSPALLVVTEGDNATFTCSFSNTSESFVLNWYRMSPSNQTDKLAAFPEDRSQPEQDCRFRVTQLPNGRDYHMSVVRARRNDSGTYLCTALTTAPKVQINESLLVELRVTERRAEVPTAHPSPSPRPAGQFQTLV

SEQ ID NO: 910 - protein, 150 aa, Artificial Sequence
  PD-1 v243 (1-150)
PGWFLDSPDRPWNPPTFSPALLVVTEGDNATFTCSFSNTSESFVLNWYRMSPSNQTDKLAAFPEDRSQPGQDHRFRVTQLPNGRDYHMSVVRARRNDSGTYLCGGITLAPKVQIDESLLVELRVTERRAEVPTAHPSPSPRPAGQFQTLV

SEQ ID NO: 911 - protein, 150 aa, Artificial Sequence
  PD-1 v244 (1-150)
PGWFLDSPDRPWNPPTFSPALLVVTEGDNATFTCSFSNTSESFVLNWYRMSPSNQTDKLAAFPEDRSQPEQDPRFRVTQLPNGRDYHMSVVRARRNDSGTYLCGCITLAPKVQIDESLLVELRVTERRAEVPTAHPSPSPRPAGQFQTLV

SEQ ID NO: 912 - protein, 150 aa, Artificial Sequence
  PD-1 v245 (1-150)
PGWFLDSPDRPWNPPTFSPALLVVTEGDNATFTCSFSNTSESFVLNWYRMSPSNQTDKLAAFPEDRSQPEQDPRFRVTQLPNGRDYHMSVVRARRNDSGTYLCGAITLAPKVQIDESLQVELRVTERRAEVPTAHPSPSPRPAGQFQTLV

SEQ ID NO: 913 - protein, 150 aa, Artificial Sequence
  PD-1 v246 (1-150)
PGWFLDSPDRPWNPPTFSPALLVVTEGDNATFTCSFSNTSESFVLNWYRMSPSNQTDKLAAFPEDRSQPGQDSRFRVTQLPNGRDYHMSVVRARRNDSGTYLCGAITLAPRVQIEESLLVELRVTERRAEVPTAHPSPSPRPAGQFQTLV

SEQ ID NO: 914 - protein, 150 aa, Artificial Sequence
  PD-1 v247 (1-150)
PGWFLDSPDRPWNPPTFSPALLVVTEGDNATFTCSFSNTSESFVLNWYRMSPSNQTDKLAAFPEDRSQPGQDRRFRVTQLPNGRGYHMSVVRARRNDSGTYLCGGITLAPKVQIDESLQVELRVTERRAEVPTAHPSPSPRPAGQFQTLV

SEQ ID NO: 915 - protein, 150 aa, Artificial Sequence
  PD-1 v248 (1-150)
PGWFLDSPDRPWNPPTFSPALLVVTEGDNATFTCSFSNTSESFVLNWYRMSPSNQTDKLAAFPEDRSQPGQDRRFRVTQLPNGRDYHMSVVRARRNDSGTYLCGAITLAPKVQIEESLWVELRVTERRAEVPTAHPSPSPRPAGQFQTLV

SEQ ID NO: 916 - protein, 150 aa, Artificial Sequence
  PD-1 v249 (1-150)
PGWFLDSPDRPWNPPTFSPALLVVTEGDNATFTCSFSNTSESFVLNWYRMSPSSQTDKLAAFPEDRSQPGQDGRFRVTQLPNGRDYHMSVVRARRNDSGTYLCGAITLAPKVQIEESLQVELRVTERRAEVPTAHPSPSPRPAGQFQTLV

SEQ ID NO: 917 - protein, 150 aa, Artificial Sequence
  PD-1 v250 (1-150)
PGWFLDSPDRPWNPPTFSPALLVVTEGDNATFTCSFSNTSESFVLNWYRMSPSNQTDKLAAFPEDRSQPGQDSRFRVTQLPNGRDYHMSVVRARRNDSGTYLCSAITLAPKVQINESLLVELRVTERRAEVPTAHPSPSPRPAGQFQTLV

SEQ ID NO: 918 - protein, 150 aa, Artificial Sequence
  PD-1 v251 (1-150)
PGWFLDSPDRPWNPPTLSPALLVVTEGDNATFTCSFSNTSESFVLNWYRMSPSNQTDKLAAFPEDRSQPGRDGRFRVTQLPNGRDYHMSVVRARRNDSGTYLCGGITLAPKVQIDESLLVELRVTERRAEVPTAHPSPSPRPAGQFQTLV

SEQ ID NO: 919 - protein, 150 aa, Artificial Sequence
  PD-1 v252 (1-150)
PGWFLDSPDRPWNPPTFSPALLVVTEGDNATFTCSFSNTSESFVLNWYRMSPSNQTDKLAAFPEDRSQPGQDGRFRVTQLPNGRDYHMSVVRARRNDSGTYLCGAITLAPKVQIEESLWVELRVTERRAEVPTAHPSPSPRPAGQFQTLV

SEQ ID NO: 920 - protein, 150 aa, Artificial Sequence
  PD-1 v253 (1-150)
PGWFLDSPDRPWNPPTFSPALLVVTEGDNATFTCSFSNTSESFVLNWYRMSPSNQTDKLAAFPEDRSQPEQDGRFRVTQLPNGRDYHMSVVRARRNDSGTYLCGCITLAPKVQIEESLLVELRVTERRAEVPTAHPSPSPRPAGQFQTLV

SEQ ID NO: 921 - protein, 150 aa, Artificial Sequence
  PD-1 v254 (1-150)
PGWFLDSPDRPWNPPTFSPALLVVTEGDNATFTCSFSNTSESFVLNWYRMSPSNQTDKLAAFPEDRSQPGQDGRFRVTQLPNGRDYHMSVVRARRNDSGTYLCAAITLAPKVQIDESLWVELRVTERRAEVPTAHPSPSPRPAGQFQTLV

SEQ ID NO: 922 - protein, 150 aa, Artificial Sequence
  PD-1 v255 (1-150)
PGWFLDSPDRPWNPPTFSPALLVVTEGDNATFTCSFSNTSESFVLNWYRMSPSNQTDKLAAFPEDRSQPGQDSRFRVTQLPNGRDYHMSVVRARRNDSGTYLCGAITLAPKVQINESLRVELRVTERRAEVPTAHPSPSPRPAGQFQTLV

SEQ ID NO: 923 - protein, 150 aa, Artificial Sequence
  PD-1 v256 (1-150)
PGWFLDSPDRPWNPPTFSPALLVVTEGDNATFTCSFSNTSESFVLNWYRMSPSNQTDKLAAFPEDRSQPGQDPRFRVTQLPNGRDYHMSVVRARRNDSGTYLCGAITLAPKVQINESLLVELRVTERRAEVPTAHPSPSPRPAGQFQTLV

SEQ ID NO: 924 - protein, 150 aa, Artificial Sequence
  PD-1 v257 (1-150)
PGWFLDSPDRPRNPPTFSPALLVVTEGDNATFTCSFSNTSESFVLNWYRMSPSNQTDKLAAFPEDRSQPGQDCRFRVTQLPNGRDYHMSVVRARRNDSGTYLCGAITLAPKVQIDESLQVELRVTERRAEVPTAHPSPSPRPAGQFQTLV

SEQ ID NO: 925 - protein, 150 aa, Artificial Sequence
  PD-1 v258 (1-150)
PGWFLDSPDRPWNPPTFSPALLVVTEGDNATFTCSFSNTSESFVLNWYRMSPSNQTDKLAAFPEDRSQPEQDGRFRVTQLPNGRDYHMSVVRARRNDSGTYLCGLISLAPKVQINESLQVELRVTERRAEVPTAHPSPSPRPAGQFQTLV

SEQ ID NO: 926 - protein, 150 aa, Artificial Sequence
  PD-1 v259 (1-150)
PGWFLDSPDRPWNPPTFSPALLVVTEGDNATFTCSFSNTSESFVLNWYRMSPSNQTDKLAAFPEDRSQPGQDCRFRVTQLPNGRDYHMSVVRARRNDSGTYLCGAITLAPKVQINESLWVELRVTERRAEVPTAHPSPSPRPAGQFQTLV

SEQ ID NO: 927 - protein, 111 aa, Artificial Sequence
  PD-1 v202 (15-125)
PTFSPALLVVTEGDNATFTCSFSNTSESFVLNWYRMSPSNQTDKLAAFPEDRSQPGQDARFRVTQLPNGRDYHMSVVRARRNDSGTYLCGAITLAPKVQINESLQVELRVT

SEQ ID NO: 928 - protein, 111 aa, Artificial Sequence
  PD-1 v203 (15-125)
PTFSPALLVVTEGDNATFTCSFSNTSESFVLNWYRMSPSNQTDKLAAFPEDRSQPGQDRRFRVTQLPNGRDYHMSVVRARRNDSGTYLCGGITLAPKVQINESLLVELRVT

SEQ ID NO: 929 - protein, 111 aa, Artificial Sequence
  PD-1 v204 (15-125)
PTFSPALLVVTEGDNATFTCSFSNTSESFVLNWYRMSPSHQTDKLAAFPEDRSQPEQDPRFRVTQLPNGRDYHMSVVRARRNDSGTYLCGAISLAPKVQIDESLLVELRVT

SEQ ID NO: 930 - protein, 111 aa, Artificial Sequence
  PD-1 v205 (15-125)
PTFSPALLVVTEGDNATFTCSFSNTSESFVLNWYRMSPSNQTDKLAAFPEDRSQPGQDGRFRVTQLPNGRDYHMSVVRARRNDSGTYLCGAITLAPKVQINESLQVELRVT

SEQ ID NO: 931 - protein, 111 aa, Artificial Sequence
  PD-1 v206 (15-125)
PTFSPALLVVTEGDNATFTCSFSNTSESFVLNWYRMSPSSQTDKLAAFPEDRSQPGQDGRFRVTQLPNGRDYHMSVVRARRNDSGTYLCGAITLAPKVQIDESLLVELRVT

SEQ ID NO: 932 - protein, 111 aa, Artificial Sequence
  PD-1 v207 (15-125)
PTFSPALLVVTEGDNATFTCSFSNTSESFVLNWYRMSPSNQTDKLAAFPEDRSQPGQDCRFRVTQLPNGRDYHMSVVRARRNDSGTYLCGAITLAPKVQIDESLWVELRVT

SEQ ID NO: 933 - protein, 111 aa, Artificial Sequence
  PD-1 v208 (15-125)
PTFSPALLVVTEGDNATFTCSFSNTSESFVLNWYRMSPSNQTDKLAAFPEDRSQPEQDPRFRVTQLPNGRDYHMSVVRARRNDSGTYLCGAITLAPKVQIEESLQVELRVT

SEQ ID NO: 934 - protein, 111 aa, Artificial Sequence
  PD-1 v209 (15-125)
PTFSPALLVVTEGDNATFTCSFSNTSESFVLNWYRMSPSNQTDKLAAFPEDRSQPGQDGRFRVTQLPNGRDYHMSVVRARRNDSGTYLCGGITLAPKVQIDESLWAELRVT

SEQ ID NO: 935 - protein, 111 aa, Artificial Sequence
  PD-1 v210,v217 (15-125)
PTFSPALLVVTEGDNATFTCSFSNTSESFVLNWYRMSPSNQTDKLAAFPEDRSQPGQDGRFRVTQLPNGRDYHMSVVRARRNDSGTYLCGAITLAPKVQIDESLLVELRVT

SEQ ID NO: 936 - protein, 111 aa, Artificial Sequence
  PD-1 v211 (15-125)
PTFSPALLVVTEGDNATFTCSFSNTSESFVLNWYRMSPSNQTDKLAAFPEDRSQPGQDSRFRVTQLPNGRDYHMSVVRARRNDSGTYLCGAITLAPKVQIDESLLVELRVT

SEQ ID NO: 937 - protein, 111 aa, Artificial Sequence
  PD-1 v212 (15-125)
PTFSPALLVVTEGDNATFTCSFSNTSESFVVNWYRMSPSNQTDKLAAFPEDRSQPGQDGRFRVTQLPNGRDYHMSVVRARRNDSGTYLCAAITLAPKVQINESLWVELRVT

SEQ ID NO: 938 - protein, 111 aa, Artificial Sequence
  PD-1 v213 (15-125)
PTFSPALLVVTEGDNATFTCSFSNTSESFVLNWYRMSPSNQTDKLAAFPEDRSQPGQDPRFRVTQLPNGRDYHMSVVRARRNDSGTYLCGAITLAPKVQIDESLQVELRVT

SEQ ID NO: 939 - protein, 111 aa, Artificial Sequence
  PD-1 v214 (15-125)
PTFSPALLVVTEGDNATFTCSFSNTSESFVLNWYRMSPSNQTDKLAAFPEDRSQPGQDSRFRVTQLPNGRDYHMSVVRARRNDSGTYLCGAITLAPKVQIEESLQVELRVT

SEQ ID NO: 940 - protein, 111 aa, Artificial Sequence
  PD-1 v215 (15-125)
PTFSPALLVVTEGDNATFTCSFSNTSESFVLNWYRMSPSNQTDKLAAFPEDRSQPGQDSRFRVTQLPNGRDYHMSVVRARRNDSGTYLCTAITLAPKVQIEESLWVELRVT

SEQ ID NO: 941 - protein, 111 aa, Artificial Sequence
  PD-1 v216 (15-125)
PTFSPALLVVTEGDNATFTCSFSNTSESFVLNWYRMSPSNQTDKLAAFPEDRSQPGQDRRFRVTQLPNGRDYHMSVVRARRNDSGTYLCGAITLAPRVQIDESLRVELRVT

SEQ ID NO: 942 - protein, 111 aa, Artificial Sequence
  PD-1 v258 (15-125)
PTFSPALLVVTEGDNATFTCSFSNTSESFVLNWYRMSPSNQTDKLAAFPEDRSQPEQDGRFRVTQLPNGRDYHMSVVRARRNDSGTYLCGLISLAPKVQINESLQVELRVT

SEQ ID NO: 943 - protein, 111 aa, Artificial Sequence
  PD-1 v218 (15-125)
PTFSPALLVVTEGDNATFTCSFSNTSESFVLNWYRMSPSNQTDKLAAFPEDRSQPEQDCRFRVTQLPNGRDYHMSVVRARRNDSGTYLCGAITLAPKVQIDESLLVELRVT

SEQ ID NO: 944 - protein, 111 aa, Artificial Sequence
  PD-1 v219 (15-125)
PTFSPALLVVTEGDNATFTCSFSNTSESFVLNWYRMSPSNQTDKLAAFPEDRSQPGQDGRFRVTQLPNGRDYHMSVVRARRNDSGTYLCVAITLAPKVQINESLLVELRVT

SEQ ID NO: 945 - protein, 111 aa, Artificial Sequence
  PD-1 v220 (15-125)
PTFSPALLVVTEGDNATFTCSFSNTSESFVLNWYRMSPSNQTDKLAAFPEDRSQPGQDSRFRVTQLPNGRDYHMSVVRARRNDSGTYLCSAITFAPKVQIDESLLVELRVT

SEQ ID NO: 946 - protein, 111 aa, Artificial Sequence
  PD-1 v221 (15-125)
PTFSPALLVVTEGDNATFTCSFSNTSESFVLNWYRMSPSNQTDKLAAFPEDRSQPGQDSRFRVTQLPNGRDYHMSVVRARRNDSGTYLCGAITLAPKVQIDESLRVELRVT

SEQ ID NO: 947 - protein, 111 aa, Artificial Sequence
  PD-1 v222 (15-125)
PTFSPALLVVTEGDNATFTCSFSNTSESFVLNWYRMSPSNQTDKLAAFPEDRSQPGQDRRFRVTQLPNGRDYHMSVVRARRNDSGTYLCGAITLAPKVQIDESLLVELRVT

SEQ ID NO: 948 - protein, 111 aa, Artificial Sequence
  PD-1 v223 (15-125)
PTFSPALLVVTEGDNATFTCSFSNTSESFVLNWYRMSPSNQTDKLAAFPEDRSQPGQDSRFRVTQLPNGRDYHMSVVRARRNDSGTYLCGAITLAPKVRIDESLLVELRVT

SEQ ID NO: 949 - protein, 111 aa, Artificial Sequence
  PD-1 v224 (15-125)
PTFSPALLVVTEGDNATFTCSFSNTSESFVLNWYRMSPSNQTDKLAAFPEDRSQPGQDSRFRVTQLPNGRDYHMSVARARRNDSGTYLCGAITLAPKVQIDESLLVELRVT

SEQ ID NO: 950 - protein, 111 aa, Artificial Sequence
  PD-1 v225 (15-125)
PTFSPALLVVTEGDNATFTCSFSNTSESFVLNWYRMSPSNQTDKLAAFPEDRSQPEQDPRFRVTQLPNGRDYHMSVVRARRNDSGTYLCGGITLAPKVQIDESLQVELRVT

SEQ ID NO: 951 - protein, 111 aa, Artificial Sequence
  PD-1 v226 (15-125)
PTFSPALLVVTEGDNATFTCSFSNTSESFVLNWYRMSPSNQTDKLAAFPEDRSQPGQDGRFRVTQLPNGRDYHMSVVRARRNDSGTYLCGGITLAPKVQIDESLLVELRVT

SEQ ID NO: 952 - protein, 111 aa, Artificial Sequence
  PD-1 v227 (15-125)
PTFSPALLVVTEGDNATFTCSFSNTSESFVLNWYRMSPSNQTDKLAAFPEDRSQPGQDGRFRVTQLPNGRDYHMSVVRARRNDSGTYLCGGITLAPKVRIDESLLVELRVT

SEQ ID NO: 953 - protein, 111 aa, Artificial Sequence
  PD-1 v228, v257 (15-125)
PTFSPALLVVTEGDNATFTCSFSNTSESFVLNWYRMSPSNQTDKLAAFPEDRSQPGQDCRFRVTQLPNGRDYHMSVVRARRNDSGTYLCGAITLAPKVQIDESLQVELRVT

SEQ ID NO: 954 - protein, 111 aa, Artificial Sequence
  PD-1 v229 (15-125)
PTFSPALLVVTEGDNATFTCSFSNTSESFVLNWYRMSPSNQTDKLAAFPEDRSQPGQDRRFRVTQLPNGRDYHMSVVRARRNDSGTYLCGAITLAPKVQINESLLVELRVT

SEQ ID NO: 955 - protein, 111 aa, Artificial Sequence
  PD-1 v230 (15-125)
PTFSPALLVVTEGDNATFTCSFSNTSESFVLNWYRMSPSNQTDKLAAFPEDRSQPGQDARFRVTQLPNGRDYHMSVVRARRNDSGTYLCGAITLAPKVRIEESLQVELRVT

SEQ ID NO: 956 - protein, 111 aa, Artificial Sequence
  PD-1 v231 (15-125)
PTFSPALLVVTEGDNATFTCSFSNTSESFVLNWYRMSPSNQTDKLAAFPEDRSQPGQDRRFRVTQLPNGRDYHMSVVRARRNDSGTYLCGAITLAPKVQIDESLQVELRVT

SEQ ID NO: 957 - protein, 111 aa, Artificial Sequence
  PD-1 v232 (15-125)
PTFSPALLVVTEGDNATFTCSFSNTSESFVLNWYRMSPSNQTDKLAAFPEDRSQPGQDGRFRVTQLPNGRDYHMSVVRARRNDSGTYLCGAISLAPKVQIDESLWVELRVT

SEQ ID NO: 958 - protein, 111 aa, Artificial Sequence
  PD-1 v233 (15-125)
PTFSPALLVVTEGDNATFTCSFSNTSESFVLNWYRMSPSNQTDKLAAFPEDRSQPGQDPRFRVTQLPNGRDYHMSVVRARRNDSGTYLCGGITLAPKVRIDESLLVELRVT

SEQ ID NO: 959 - protein, 111 aa, Artificial Sequence
  PD-1 v234 (15-125)
PTFSPALLVVTEGDNATFTCSFSNTSESFVLNWYRMSPSNQTDKLAAFPEDRSQPGQDRRFRVTQLPNGRDYHMSVVRARRNDSGTYLCGGITLAPKVQIDESLLVELRVT

SEQ ID NO: 960 - protein, 111 aa, Artificial Sequence
  PD-1 v235 (15-125)
PTFSPALLVVTEGDNATFTCSFSNTSESFVLNWYRMSPSNQTDKLAAFPEDRSQPGQDARFRVTQLPNGRDYHMSVVRARRNDSGTYLCGAITLAPKVQIDESLLVELRVT

SEQ ID NO: 961 - protein, 111 aa, Artificial Sequence
  PD-1 v236 (15-125)
PTFSPALLVVTEGDNATFTCSFSNTSESFVLNWYRMSPSNQTDKLAAFPEDRSQSGQDRRFRVTQLPNGRDYHMSVVRARRNDSGTYLCGAITLAPKVQIDESLWVELRVT

SEQ ID NO: 962 - protein, 111 aa, Artificial Sequence
  PD-1 v237 (15-125)
PTFSPALLVVTEGDNATFTCSFSNTSESFVLNWYRMSPSNQTDKLAAFPEDRSQPGQDSRFRVTQLPNGRDYHMSVVRARRNDSGTYLCSAITLAPKVQIEESLWVELRVT

SEQ ID NO: 963 - protein, 111 aa, Artificial Sequence
  PD-1 v238 (15-125)
PTFSPALLVVTEGDNATFTCSFSNTSESFVLNWYRMSPSNQTDKLAAFPEDRSRPGQDSRFRVTQLPNGRDYHMSVVRARRNDSGTYLCGAITLAPKVQIDESLQVELRVT

SEQ ID NO: 964 - protein, 111 aa, Artificial Sequence
  PD-1 v239 (15-125)
PTFSPALLVVTEGDNATFTCSFSNTSESFVLNWYRMSPSNQTDKLAAFPEDRSQPGQDRRFRVTQLPNGRDYHMSVVRARRNDSGTYLCGAITLAPKVQINESLQVELRVT

SEQ ID NO: 965 - protein, 111 aa, Artificial Sequence
  PD-1 v240 (15-125)
PTFSPALLVVTEGDNATFTCSFSNTSESFVLNWYRMSPSNQTDKLAAFPEDRSQPEQDRRFRVTQLPNGRDYHMSVVRARRNDSGTYLCGAITLAPKVQINESLQVELRVT

SEQ ID NO: 966 - protein, 111 aa, Artificial Sequence
  PD-1 v241 (15-125)
PTFSPALLVVTEGDNATFTCSFSNTSESFVLNWYRMSPSNQTDKLAAFPEDRSQPGQDSRFRVTQLPNGRDYHMSVVRARRNDSGTYLCGAITLAPKVQIDESLWVELRVT

SEQ ID NO: 967 - protein, 111 aa, Artificial Sequence
  PD-1 v242 (15-125)
PTFSPALLVVTEGDNATFTCSFSNTSESFVLNWYRMSPSNQTDKLAAFPEDRSQPEQDCRFRVTQLPNGRDYHMSVVRARRNDSGTYLCTALTTAPKVQINESLLVELRVT

SEQ ID NO: 968 - protein, 111 aa, Artificial Sequence
  PD-1 v243 (15-125)
PTFSPALLVVTEGDNATFTCSFSNTSESFVLNWYRMSPSNQTDKLAAFPEDRSQPGQDHRFRVTQLPNGRDYHMSVVRARRNDSGTYLCGGITLAPKVQIDESLLVELRVT

SEQ ID NO: 969 - protein, 111 aa, Artificial Sequence
  PD-1 v244 (15-125)
PTFSPALLVVTEGDNATFTCSFSNTSESFVLNWYRMSPSNQTDKLAAFPEDRSQPEQDPRFRVTQLPNGRDYHMSVVRARRNDSGTYLCGCITLAPKVQIDESLLVELRVT

SEQ ID NO: 970 - protein, 111 aa, Artificial Sequence
  PD-1 v245 (15-125)
PTFSPALLVVTEGDNATFTCSFSNTSESFVLNWYRMSPSNQTDKLAAFPEDRSQPEQDPRFRVTQLPNGRDYHMSVVRARRNDSGTYLCGAITLAPKVQIDESLQVELRVT

SEQ ID NO: 971 - protein, 111 aa, Artificial Sequence
  PD-1 v246 (15-125)
PTFSPALLVVTEGDNATFTCSFSNTSESFVLNWYRMSPSNQTDKLAAFPEDRSQPGQDSRFRVTQLPNGRDYHMSVVRARRNDSGTYLCGAITLAPRVQIEESLLVELRVT

SEQ ID NO: 972 - protein, 111 aa, Artificial Sequence
  PD-1 v247 (15-125)
PTFSPALLVVTEGDNATFTCSFSNTSESFVLNWYRMSPSNQTDKLAAFPEDRSQPGQDRRFRVTQLPNGRGYHMSVVRARRNDSGTYLCGGITLAPKVQIDESLQVELRVT

SEQ ID NO: 973 - protein, 111 aa, Artificial Sequence
  PD-1 v248 (15-125)
PTFSPALLVVTEGDNATFTCSFSNTSESFVLNWYRMSPSNQTDKLAAFPEDRSQPGQDRRFRVTQLPNGRDYHMSVVRARRNDSGTYLCGAITLAPKVQIEESLWVELRVT

SEQ ID NO: 974 - protein, 111 aa, Artificial Sequence
  PD-1 v249 (15-125)
PTFSPALLVVTEGDNATFTCSFSNTSESFVLNWYRMSPSSQTDKLAAFPEDRSQPGQDGRFRVTQLPNGRDYHMSVVRARRNDSGTYLCGAITLAPKVQIEESLQVELRVT

SEQ ID NO: 975 - protein, 111 aa, Artificial Sequence
  PD-1 v250 (15-125)
PTFSPALLVVTEGDNATFTCSFSNTSESFVLNWYRMSPSNQTDKLAAFPEDRSQPGQDSRFRVTQLPNGRDYHMSVVRARRNDSGTYLCSAITLAPKVQINESLLVELRVT

SEQ ID NO: 976 - protein, 111 aa, Artificial Sequence
  PD-1 v251 (15-125)
PTLSPALLVVTEGDNATFTCSFSNTSESFVLNWYRMSPSNQTDKLAAFPEDRSQPGRDGRFRVTQLPNGRDYHMSVVRARRNDSGTYLCGGITLAPKVQIDESLLVELRVT

SEQ ID NO: 977 - protein, 111 aa, Artificial Sequence
  PD-1 v252 (15-125)
PTFSPALLVVTEGDNATFTCSFSNTSESFVLNWYRMSPSNQTDKLAAFPEDRSQPGQDGRFRVTQLPNGRDYHMSVVRARRNDSGTYLCGAITLAPKVQIEESLWVELRVT

SEQ ID NO: 978 - protein, 111 aa, Artificial Sequence
  PD-1 v253 (15-125)
PTFSPALLVVTEGDNATFTCSFSNTSESFVLNWYRMSPSNQTDKLAAFPEDRSQPEQDGRFRVTQLPNGRDYHMSVVRARRNDSGTYLCGCITLAPKVQIEESLLVELRVT

SEQ ID NO: 979 - protein, 111 aa, Artificial Sequence
  PD-1 v254 (15-125)
PTFSPALLVVTEGDNATFTCSFSNTSESFVLNWYRMSPSNQTDKLAAFPEDRSQPGQDGRFRVTQLPNGRDYHMSVVRARRNDSGTYLCAAITLAPKVQIDESLWVELRVT

SEQ ID NO: 980 - protein, 111 aa, Artificial Sequence
  PD-1 v255 (15-125)
PTFSPALLVVTEGDNATFTCSFSNTSESFVLNWYRMSPSNQTDKLAAFPEDRSQPGQDSRFRVTQLPNGRDYHMSVVRARRNDSGTYLCGAITLAPKVQINESLRVELRVT

SEQ ID NO: 981 - protein, 111 aa, Artificial Sequence
  PD-1 v256 (15-125)
PTFSPALLVVTEGDNATFTCSFSNTSESFVLNWYRMSPSNQTDKLAAFPEDRSQPGQDPRFRVTQLPNGRDYHMSVVRARRNDSGTYLCGAITLAPKVQINESLLVELRVT

SEQ ID NO: 982 - protein, 111 aa, Artificial Sequence
  PD-1 v259 (15-125)
PTFSPALLVVTEGDNATFTCSFSNTSESFVLNWYRMSPSNQTDKLAAFPEDRSQPGQDCRFRVTQLPNGRDYHMSVVRARRNDSGTYLCGAITLAPKVQINESLWVELRVT

SEQ ID NO: 983 - protein, 104 aa, Artificial Sequence
  CD80 WT IgV
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSV

SEQ ID NO: 984 - protein, 107 aa, Artificial Sequence
  CD80 WT IgV
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKAD

SEQ ID NO: 985 - protein, 127 aa, Homo sapiens
  MISC_FEATURE: PD-1(wt 1-127)
  ref <308>: DATABASE ACCESSION NUMBER: UniProt/Q15116.3
  ref <309>: DATABASE ENTRY DATE: 2018-09-12
  ref <313>: RELEVANT RESIDUES IN SEQ ID NO: (1)..(127)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTER

SEQ ID NO: 986 - protein, 48 aa, Artificial Sequence
  CD8 (C181S) hinge
AKPTTTPAPRPPTPAPTIASQPLSLRPEACRPAAGGAVHTRGLDFASD

SEQ ID NO: 987 - protein, 48 aa, Artificial Sequence
  CD8 wild-type hinge
AKPTTTPAPRPPTPAPTIASQPLSLRPEACRPAAGGAVHTRGLDFACD

SEQ ID NO: 988 - protein, 26 aa, Artificial Sequence
  CD28 transmembrane domain
WVLVVVGGVLACYSLLVTVAFIIFWV

SEQ ID NO: 989 - protein, 27 aa, Artificial Sequence
  41BB transmembrane domain
IISFFLALTSTALLFLLFFLTLRFSVV

SEQ ID NO: 990 - protein, 37 aa, Artificial Sequence
  Truncated 4-1BB-derived costimulatory domain
KRGRKKLLYIFKQPFMRPVQTTQEEDGCSCRFPEEEE

SEQ ID NO: 991 - protein, 21 aa, Artificial Sequence
  ICOS transmembrane domain
FWLPIGCAAFVVVCILGCILI

SEQ ID NO: 992 - protein, 38 aa, Artificial Sequence
  ICOS intracellular domain
CWLTKKKYSSSVHDPNGEYMFMRAVNTAKKSRLTDVTL

SEQ ID NO: 993 - protein, 237 aa, Artificial Sequence
  PD-1 v201  (vCD8) CD28_CD28
DSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERAKPTTTPAPRPPTPAPTIASQPLSLRPEACRPAAGGAVHTRGLDFASDWVLVVVGGVLACYSLLVTVAFIIFWVRSKRSRLLHSDYMNMTPRRPGPTRKHYQPYAPPRDFAAYRS

SEQ ID NO: 994 - protein, 239 aa, Artificial Sequence
  PD-1 v201  (vCD8) 41BB_41BB
DSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERAKPTTTPAPRPPTPAPTIASQPLSLRPEACRPAAGGAVHTRGLDFASDIISFFLALTSTALLFLLFFLTLRFSVVKRGRKKLLYIFKQPFMRPVQTTQEEDGCSCRFPEEEEGGCEL

SEQ ID NO: 995 - protein, 231 aa, Artificial Sequence
  PD-1 v201  (vCD8) ICOS_ICOS
DSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERAKPTTTPAPRPPTPAPTIASQPLSLRPEACRPAAGGAVHTRGLDFASDLKFWLPIGCAAFVVVCILGCILICWLTKKKYSSSVHDPNGEYMFMRAVNTAKKSRLTDVTL

SEQ ID NO: 996 - protein, 279 aa, Artificial Sequence
  PD-1 v201  (vCD8) CD28_CD28/41BB
DSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERAKPTTTPAPRPPTPAPTIASQPLSLRPEACRPAAGGAVHTRGLDFASDWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCEL

SEQ ID NO: 997 - protein, 275 aa, Artificial Sequence
  PD-1 v201  (vCD8) CD28_CD28/ICOS
DSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERAKPTTTPAPRPPTPAPTIASQPLSLRPEACRPAAGGAVHTRGLDFASDWVLVVVGGVLACYSLLVTVAFIIFWVRSKRSRLLHSDYMNMTPRRPGPTRKHYQPYAPPRDFAAYRSCWLTKKKYSSSVHDPNGEYMFMRAVNTAKKSRLTDVTL

SEQ ID NO: 998 - protein, 280 aa, Artificial Sequence
  PD-1 v201  (vCD8) 41BB_41BB/CD28
DSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERAKPTTTPAPRPPTPAPTIASQPLSLRPEACRPAAGGAVHTRGLDFASDIISFFLALTSTALLFLLFFLTLRFSVVKRGRKKLLYIFKQPFMRPVQTTQEEDGCSCRFPEEEEGGCELRSKRSRLLHSDYMNMTPRRPGPTRKHYQPYAPPRDFAAYRS

SEQ ID NO: 999 - protein, 277 aa, Artificial Sequence
  PD-1 v201  (vCD8) 41BB_41BB/ICOS
DSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERAKPTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEEGGCELCWLTKKKYSSSVHDPNGEYMFMRAVNTAKKSRLTDVTL

SEQ ID NO: 1000 - protein, 270 aa, Artificial Sequence
  PD-1 v201  (vCD8) ICOS_ICOS/CD28
DSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERAKPTTTPAPRPPTPAPTIASQPLSLRPEACRPAAGGAVHTRGLDFASDFWLPIGCAAFVVVCILGCILICWLTKKKYSSSVHDPNGEYMFMRAVNTAKKSRLTDVTLRSKRSRLLHSDYMNMTPRRPGPTRKHYQPYAPPRDFAAYRS

SEQ ID NO: 1001 - protein, 271 aa, Artificial Sequence
  PD-1 v201  (vCD8) ICOS_ICOS/41BB
DSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERAKPTTTPAPRPPTPAPTIASQPLSLRPEACRPAAGGAVHTRGLDFASDFWLPIGCAAFVVVCILGCILICWLTKKKYSSSVHDPNGEYMFMRAVNTAKKSRLTDVTLKRGRKKLLYIFKQPFMRPVQTTQEEDGCSCRFPEEEEGGCEL

SEQ ID NO: 1002 - protein, 317 aa, Artificial Sequence
  PD-1 v201  (vCD8)CD28_CD28/ICOS/41BB
DSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERAKPTTTPAPRPPTPAPTIASQPLSLRPEACRPAAGGAVHTRGLDFASDWVLVVVGGVLACYSLLVTVAFIIFWVRSKRSRLLHSDYMNMTPRRPGPTRKHYQPYAPPRDFAAYRSCWLTKKKYSSSVHDPNGEYMFMRAVNTAKKSRLTDVTLKRGRKKLLYIFKQPFMRPVQTTQEEDGCSCRFPEEEEGGCEL

SEQ ID NO: 1003 - protein, 200 aa, Artificial Sequence
  PD-1 v201  (vCD8)CD28_RSKS
DSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERAKPTTTPAPRPPTPAPTIASQPLSLRPEACRPAAGGAVHTRGLDFASDWVLVVVGGVLACYSLLVTVAFIIFWVRSKS

SEQ ID NO: 1004 - protein, 242 aa, Artificial Sequence
  PD-1 WT  (CD8) CD28_CD28
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERAKPTTTPAPRPPTPAPTIASQPLSLRPEACRPAAGGAVHTRGLDFACDWVLVVVGGVLACYSLLVTVAFIIFWVRSKRSRLLHSDYMNMTPRRPGPTRKHYQPYAPPRDFAAYRS

SEQ ID NO: 1005 - protein, 284 aa, Artificial Sequence
  PD-1 WT  (CD8) CD28_CD28/41BB
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERAKPTTTPAPRPPTPAPTIASQPLSLRPEACRPAAGGAVHTRGLDFACDWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCEL

SEQ ID NO: 1006 - protein, 280 aa, Artificial Sequence
  PD-1 WT  (CD8) CD28_CD28/ICOS
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERAKPTTTPAPRPPTPAPTIASQPLSLRPEACRPAAGGAVHTRGLDFACDWVLVVVGGVLACYSLLVTVAFIIFWVRSKRSRLLHSDYMNMTPRRPGPTRKHYQPYAPPRDFAAYRSCWLTKKKYSSSVHDPNGEYMFMRAVNTAKKSRLTDVTL

SEQ ID NO: 1007 - protein, 322 aa, Artificial Sequence
  PD-1 WT  (CD8) CD28_CD28/ICOS/41BB
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERAKPTTTPAPRPPTPAPTIASQPLSLRPEACRPAAGGAVHTRGLDFACDWVLVVVGGVLACYSLLVTVAFIIFWVRSKRSRLLHSDYMNMTPRRPGPTRKHYQPYAPPRDFAAYRSCWLTKKKYSSSVHDPNGEYMFMRAVNTAKKSRLTDVTLKRGRKKLLYIFKQPFMRPVQTTQEEDGCSCRFPEEEEGGCEL

SEQ ID NO: 1008 - protein, 205 aa, Artificial Sequence
  PD-1 WT  (CD8) CD28_RSKS
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERAKPTTTPAPRPPTPAPTIASQPLSLRPEACRPAAGGAVHTRGLDFACDWVLVVVGGVLACYSLLVTVAFIIFWVRSKS

SEQ ID NO: 1009 - protein, 242 aa, Artificial Sequence
  PD-1 WT  (vCD8) CD28_CD28
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERAKPTTTPAPRPPTPAPTIASQPLSLRPEACRPAAGGAVHTRGLDFASDWVLVVVGGVLACYSLLVTVAFIIFWVRSKRSRLLHSDYMNMTPRRPGPTRKHYQPYAPPRDFAAYRS

SEQ ID NO: 1010 - protein, 284 aa, Artificial Sequence
  PD-1 WT  (vCD8) CD28_CD28/41BB
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERAKPTTTPAPRPPTPAPTIASQPLSLRPEACRPAAGGAVHTRGLDFASDWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCEL

SEQ ID NO: 1011 - protein, 280 aa, Artificial Sequence
  PD-1 WT  (vCD8) CD28_CD28/ICOS
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERAKPTTTPAPRPPTPAPTIASQPLSLRPEACRPAAGGAVHTRGLDFASDWVLVVVGGVLACYSLLVTVAFIIFWVRSKRSRLLHSDYMNMTPRRPGPTRKHYQPYAPPRDFAAYRSCWLTKKKYSSSVHDPNGEYMFMRAVNTAKKSRLTDVTL

SEQ ID NO: 1012 - protein, 322 aa, Artificial Sequence
  PD-1 WT  (vCD8) CD28_CD28/ICOS/41BB
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERAKPTTTPAPRPPTPAPTIASQPLSLRPEACRPAAGGAVHTRGLDFASDWVLVVVGGVLACYSLLVTVAFIIFWVRSKRSRLLHSDYMNMTPRRPGPTRKHYQPYAPPRDFAAYRSCWLTKKKYSSSVHDPNGEYMFMRAVNTAKKSRLTDVTLKRGRKKLLYIFKQPFMRPVQTTQEEDGCSCRFPEEEEGGCEL

SEQ ID NO: 1013 - protein, 205 aa, Artificial Sequence
  PD-1 WT  (vCD8) CD28_RSKS
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERAKPTTTPAPRPPTPAPTIASQPLSLRPEACRPAAGGAVHTRGLDFASDWVLVVVGGVLACYSLLVTVAFIIFWVRSKS

SEQ ID NO: 1014 - protein, 239 aa, Artificial Sequence
  PD-1 WT  (vCD8) CD28_ICOS
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERAKPTTTPAPRPPTPAPTIASQPLSLRPEACRPAAGGAVHTRGLDFASDWVLVVVGGVLACYSLLVTVAFIIFWVCWLTKKKYSSSVHDPNGEYMFMRAVNTAKKSRLTDVTL

SEQ ID NO: 1015 - protein, 243 aa, Artificial Sequence
  PD-1 WT  (vCD8) CD28_41BB
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERAKPTTTPAPRPPTPAPTIASQPLSLRPEACRPAAGGAVHTRGLDFASDWVLVVVGGVLACYSLLVTVAFIIFWVKRGRKKLLYIFKQPFMRPVQTTQEEDGCSCRFPEEEEGGCEL

SEQ ID NO: 1016 - protein, 281 aa, Artificial Sequence
  PD-1 WT  (vCD8) CD28_ICOS/41BB
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERAKPTTTPAPRPPTPAPTIASQPLSLRPEACRPAAGGAVHTRGLDFASDWVLVVVGGVLACYSLLVTVAFIIFWVCWLTKKKYSSSVHDPNGEYMFMRAVNTAKKSRLTDVTLKRGRKKLLYIFKQPFMRPVQTTQEEDGCSCRFPEEEEGGCEL

SEQ ID NO: 1017 - protein, 281 aa, Artificial Sequence
  PD-1 WT  (vCD8) CD28_41BB/ICOS
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERAKPTTTPAPRPPTPAPTIASQPLSLRPEACRPAAGGAVHTRGLDFASDWVLVVVGGVLACYSLLVTVAFIIFWVKRGRKKLLYIFKQPFMRPVQTTQEEDGCSCRFPEEEEGGCELCWLTKKKYSSSVHDPNGEYMFMRAVNTAKKSRLTDVTL

SEQ ID NO: 1018 - protein, 234 aa, Artificial Sequence
  PD-1 v201  (vCD8) CD28_ICOS
DSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERAKPTTTPAPRPPTPAPTIASQPLSLRPEACRPAAGGAVHTRGLDFASDWVLVVVGGVLACYSLLVTVAFIIFWVCWLTKKKYSSSVHDPNGEYMFMRAVNTAKKSRLTDVTL

SEQ ID NO: 1019 - protein, 238 aa, Artificial Sequence
  PD-1 v201  (vCD8) CD28_41BB
DSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERAKPTTTPAPRPPTPAPTIASQPLSLRPEACRPAAGGAVHTRGLDFASDWVLVVVGGVLACYSLLVTVAFIIFWVKRGRKKLLYIFKQPFMRPVQTTQEEDGCSCRFPEEEEGGCEL

SEQ ID NO: 1020 - protein, 276 aa, Artificial Sequence
  PD-1 v201  (vCD8) CD28_ICOS/41BB
DSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERAKPTTTPAPRPPTPAPTIASQPLSLRPEACRPAAGGAVHTRGLDFASDWVLVVVGGVLACYSLLVTVAFIIFWVCWLTKKKYSSSVHDPNGEYMFMRAVNTAKKSRLTDVTLKRGRKKLLYIFKQPFMRPVQTTQEEDGCSCRFPEEEEGGCEL

SEQ ID NO: 1021 - protein, 276 aa, Artificial Sequence
  PD-1 v201  (vCD8) CD28_41BB/ICOS
DSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERAKPTTTPAPRPPTPAPTIASQPLSLRPEACRPAAGGAVHTRGLDFASDWVLVVVGGVLACYSLLVTVAFIIFWVKRGRKKLLYIFKQPFMRPVQTTQEEDGCSCRFPEEEEGGCELCWLTKKKYSSSVHDPNGEYMFMRAVNTAKKSRLTDVTL

SEQ ID NO: 1022 - protein, 237 aa, Artificial Sequence
  PD-1 v196  (vCD8) CD28_CD28
DSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTERAKPTTTPAPRPPTPAPTIASQPLSLRPEACRPAAGGAVHTRGLDFASDWVLVVVGGVLACYSLLVTVAFIIFWVRSKRSRLLHSDYMNMTPRRPGPTRKHYQPYAPPRDFAAYRS

SEQ ID NO: 1023 - protein, 279 aa, Artificial Sequence
  PD-1 v196  (vCD8) CD28_CD28/41BB
DSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTERAKPTTTPAPRPPTPAPTIASQPLSLRPEACRPAAGGAVHTRGLDFASDWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCEL

SEQ ID NO: 1024 - protein, 275 aa, Artificial Sequence
  PD-1 v196  (vCD8) CD28_CD28/ICOS
DSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTERAKPTTTPAPRPPTPAPTIASQPLSLRPEACRPAAGGAVHTRGLDFASDWVLVVVGGVLACYSLLVTVAFIIFWVRSKRSRLLHSDYMNMTPRRPGPTRKHYQPYAPPRDFAAYRSCWLTKKKYSSSVHDPNGEYMFMRAVNTAKKSRLTDVTL

SEQ ID NO: 1025 - protein, 317 aa, Artificial Sequence
  PD-1 v196  (vCD8) CD28_CD28/ICOS/41BB
DSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTERAKPTTTPAPRPPTPAPTIASQPLSLRPEACRPAAGGAVHTRGLDFASDWVLVVVGGVLACYSLLVTVAFIIFWVRSKRSRLLHSDYMNMTPRRPGPTRKHYQPYAPPRDFAAYRSCWLTKKKYSSSVHDPNGEYMFMRAVNTAKKSRLTDVTLKRGRKKLLYIFKQPFMRPVQTTQEEDGCSCRFPEEEEGGCEL

SEQ ID NO: 1026 - protein, 234 aa, Artificial Sequence
  PD-1 v196  (vCD8) CD28_ICOS
DSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTERAKPTTTPAPRPPTPAPTIASQPLSLRPEACRPAAGGAVHTRGLDFASDWVLVVVGGVLACYSLLVTVAFIIFWVCWLTKKKYSSSVHDPNGEYMFMRAVNTAKKSRLTDVTL

SEQ ID NO: 1027 - protein, 238 aa, Artificial Sequence
  PD-1 v196  (vCD8) CD28_41BB
DSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTERAKPTTTPAPRPPTPAPTIASQPLSLRPEACRPAAGGAVHTRGLDFASDWVLVVVGGVLACYSLLVTVAFIIFWVKRGRKKLLYIFKQPFMRPVQTTQEEDGCSCRFPEEEEGGCEL

SEQ ID NO: 1028 - protein, 276 aa, Artificial Sequence
  PD-1 v196  (vCD8) CD28_ICOS/41BB
DSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTERAKPTTTPAPRPPTPAPTIASQPLSLRPEACRPAAGGAVHTRGLDFASDWVLVVVGGVLACYSLLVTVAFIIFWVCWLTKKKYSSSVHDPNGEYMFMRAVNTAKKSRLTDVTLKRGRKKLLYIFKQPFMRPVQTTQEEDGCSCRFPEEEEGGCEL

SEQ ID NO: 1029 - protein, 276 aa, Artificial Sequence
  PD-1 v196  (vCD8) CD28_41BB/ICOS
DSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTERAKPTTTPAPRPPTPAPTIASQPLSLRPEACRPAAGGAVHTRGLDFASDWVLVVVGGVLACYSLLVTVAFIIFWVKRGRKKLLYIFKQPFMRPVQTTQEEDGCSCRFPEEEEGGCELCWLTKKKYSSSVHDPNGEYMFMRAVNTAKKSRLTDVTL

SEQ ID NO: 1030 - protein, 239 aa, Artificial Sequence
  PD-1 v196  (vCD8) 41BB_41BB
DSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTERAKPTTTPAPRPPTPAPTIASQPLSLRPEACRPAAGGAVHTRGLDFASDIISFFLALTSTALLFLLFFLTLRFSVVKRGRKKLLYIFKQPFMRPVQTTQEEDGCSCRFPEEEEGGCEL

SEQ ID NO: 1031 - protein, 229 aa, Artificial Sequence
  PD-1 v196  (vCD8) ICOS_ICOS
DSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTERAKPTTTPAPRPPTPAPTIASQPLSLRPEACRPAAGGAVHTRGLDFASDFWLPIGCAAFVVVCILGCILICWLTKKKYSSSVHDPNGEYMFMRAVNTAKKSRLTDVTL

SEQ ID NO: 1032 - protein, 200 aa, Artificial Sequence
  PD-1 v196  (vCD8) CD28_RSKS
DSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTERAKPTTTPAPRPPTPAPTIASQPLSLRPEACRPAAGGAVHTRGLDFASDWVLVVVGGVLACYSLLVTVAFIIFWVRSKS

SEQ ID NO: 1033 - protein, 237 aa, Artificial Sequence
  PD-1 v196  (CD8) CD28_CD28
DSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTERAKPTTTPAPRPPTPAPTIASQPLSLRPEACRPAAGGAVHTRGLDFACDWVLVVVGGVLACYSLLVTVAFIIFWVRSKRSRLLHSDYMNMTPRRPGPTRKHYQPYAPPRDFAAYRS

SEQ ID NO: 1034 - protein, 279 aa, Artificial Sequence
  PD-1 v196  (CD8) CD28_CD28/41BB
DSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTERAKPTTTPAPRPPTPAPTIASQPLSLRPEACRPAAGGAVHTRGLDFACDWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEEGGCEL

SEQ ID NO: 1035 - protein, 275 aa, Artificial Sequence
  PD-1 v196  (CD8) CD28_CD28/ICOS
DSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTERAKPTTTPAPRPPTPAPTIASQPLSLRPEACRPAAGGAVHTRGLDFACDWVLVVVGGVLACYSLLVTVAFIIFWVRSKRSRLLHSDYMNMTPRRPGPTRKHYQPYAPPRDFAAYRSCWLTKKKYSSSVHDPNGEYMFMRAVNTAKKSRLTDVTL

SEQ ID NO: 1036 - protein, 317 aa, Artificial Sequence
  PD-1 v196  (CD8) CD28_CD28/ICOS/41BB
DSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTERAKPTTTPAPRPPTPAPTIASQPLSLRPEACRPAAGGAVHTRGLDFACDWVLVVVGGVLACYSLLVTVAFIIFWVRSKRSRLLHSDYMNMTPRRPGPTRKHYQPYAPPRDFAAYRSCWLTKKKYSSSVHDPNGEYMFMRAVNTAKKSRLTDVTLKRGRKKLLYIFKQPFMRPVQTTQEEDGCSCRFPEEEEGGCEL

SEQ ID NO: 1037 - DNA, 711 bp, Artificial Sequence
  PD-1 v201  (vCD8) CD28_CD28
gactccccagacaggccctggaacccccccaccttctccccagccctgctcgtggtgaccgaaggggacaacgccaccttcacctgcagcttctccaacacatcggagagcttccacgtgatctggcaccgcgaaagccccagcggccagacggacacactggccgccttccccgaggaccgcagccagcccggccaggactgccgcttccgtgtcacacaactgcccaacgggcgtgacttccacatgagcgtggtcagggcccggcgcaatgacagcggcacctacgtgtgtggggtgatctccctggcccccaagatccagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgcggagtaagagaagccgcctcctccacagcgactacatgaatatgaccccgcgcaggccggggcctacaagaaagcattaccagccgtatgctccaccacgagattttgctgcttacaggagc

SEQ ID NO: 1038 - DNA, 717 bp, Artificial Sequence
  PD-1 v201  (vCD8) 41BB_41BB
gactccccagacaggccctggaacccccccaccttctccccagccctgctcgtggtgaccgaaggggacaacgccaccttcacctgcagcttctccaacacatcggagagcttccacgtgatctggcaccgcgaaagccccagcggccagacggacacactggccgccttccccgaggaccgcagccagcccggccaggactgccgcttccgtgtcacacaactgcccaacgggcgtgacttccacatgagcgtggtcagggcccggcgcaatgacagcggcacctacgtgtgtggggtgatctccctggcccccaagatccagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgacatcatatcattcttcttggctctgacctctacagctctgctgttccttttgttttttctcacactccgcttttctgtagttaaacggggtagaaagaagctcctctacatattcaaacagccgtttatgagacccgttcagactacccaagaagaggatgggtgtagttgccgctttcccgaggaggaagagggaggatgtgaactg

SEQ ID NO: 1039 - DNA, 693 bp, Artificial Sequence
  PD-1 v201  (vCD8) ICOS_ICOS
gactccccagacaggccctggaacccccccaccttctccccagccctgctcgtggtgaccgaaggggacaacgccaccttcacctgcagcttctccaacacatcggagagcttccacgtgatctggcaccgcgaaagccccagcggccagacggacacactggccgccttccccgaggaccgcagccagcccggccaggactgccgcttccgtgtcacacaactgcccaacgggcgtgacttccacatgagcgtggtcagggcccggcgcaatgacagcggcacctacgtgtgtggggtgatctccctggcccccaagatccagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtgcacaccagaggactggatttcgccagcgacttgaaattctggctccccatcggatgcgctgcgttcgtcgttgtctgcattcttggatgcatccttatttgctggctgaccaaaaagaaatactcatctagcgttcacgacccgaacggcgaatacatgttcatgcgagcggtaaacaccgcaaagaaatcacggttgaccgacgtaaccctt

SEQ ID NO: 1040 - DNA, 837 bp, Artificial Sequence
  PD-1 v201  (vCD8) CD28_CD28/41BB
gactccccagacaggccctggaacccccccaccttctccccagccctgctcgtggtgaccgaaggggacaacgccaccttcacctgcagcttctccaacacatcggagagcttccacgtgatctggcaccgcgaaagccccagcggccagacggacacactggccgccttccccgaggaccgcagccagcccggccaggactgccgcttccgtgtcacacaactgcccaacgggcgtgacttccacatgagcgtggtcagggcccggcgcaatgacagcggcacctacgtgtgtggggtgatctccctggcccccaagatccagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgcggagtaagagaagccgcctcctccacagcgactacatgaatatgaccccgcgcaggccggggcctacaagaaagcattaccagccgtatgctccaccacgagattttgctgcttacaggagcaaacggggtagaaagaagctcctctacatattcaaacagccgtttatgagacccgttcagactacccaagaagaggatgggtgtagttgccgctttcccgaggaggaagagggaggatgtgaactg

SEQ ID NO: 1041 - DNA, 825 bp, Artificial Sequence
  PD-1 v201  (vCD8) CD28_CD28/ICOS
gactccccagacaggccctggaacccccccaccttctccccagccctgctcgtggtgaccgaaggggacaacgccaccttcacctgcagcttctccaacacatcggagagcttccacgtgatctggcaccgcgaaagccccagcggccagacggacacactggccgccttccccgaggaccgcagccagcccggccaggactgccgcttccgtgtcacacaactgcccaacgggcgtgacttccacatgagcgtggtcagggcccggcgcaatgacagcggcacctacgtgtgtggggtgatctccctggcccccaagatccagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtactggtagtggtggggggggtcctggcctgctattctctgctcgtcacggtcgcctttatcattttttgggtgcggagtaagagaagccgcctcctccacagcgactacatgaatatgaccccgcgcaggccggggcctacaagaaagcattaccagccgtatgctccaccacgagattttgctgcttacaggagctgctggctgaccaaaaagaaatactcatctagcgttcacgacccgaacggcgaatacatgttcatgcgagcggtaaacaccgcaaagaaatcacggttgaccgacgtaaccctt

SEQ ID NO: 1042 - DNA, 840 bp, Artificial Sequence
  PD-1 v201  (vCD8) 41BB_41BB/CD28
gactccccagacaggccctggaacccccccaccttctccccagccctgctcgtggtgaccgaaggggacaacgccaccttcacctgcagcttctccaacacatcggagagcttccacgtgatctggcaccgcgaaagccccagcggccagacggacacactggccgccttccccgaggaccgcagccagcccggccaggactgccgcttccgtgtcacacaactgcccaacgggcgtgacttccacatgagcgtggtcagggcccggcgcaatgacagcggcacctacgtgtgtggggtgatctccctggcccccaagatccagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgacatcatatcattcttcttggctctgacctctacagctctgctgttccttttgttttttctcacactccgcttttctgtagttaaacggggtagaaagaagctcctctacatattcaaacagccgtttatgagacccgttcagactacccaagaagaggatgggtgtagttgccgctttcccgaggaggaagagggaggatgtgaactgcggagtaagagaagccgcctcctccacagcgactacatgaatatgaccccgcgcaggccggggcctacaagaaagcattaccagccgtatgctccaccacgagattttgctgcttacaggagc

SEQ ID NO: 1043 - DNA, 831 bp, Artificial Sequence
  PD-1 v201  (vCD8) 41BB_41BB/ICOS
gactccccagacaggccctggaacccccccaccttctccccagccctgctcgtggtgaccgaaggggacaacgccaccttcacctgcagcttctccaacacatcggagagcttccacgtgatctggcaccgcgaaagccccagcggccagacggacacactggccgccttccccgaggaccgcagccagcccggccaggactgccgcttccgtgtcacacaactgcccaacgggcgtgacttccacatgagcgtggtcagggcccggcgcaatgacagcggcacctacgtgtgtggggtgatctccctggcccccaagatccagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtgcacaccagaggactggatttcgcctgcgacatcatatcattcttcttggctctgacctctacagctctgctgttccttttgttttttctcacactccgcttttctgtagttaaacggggtagaaagaagctcctctacatattcaaacagccgtttatgagacccgttcagactacccaagaagaggatgggtgtagttgccgctttcccgaggaggaagagggaggatgtgaactgtgctggctgaccaaaaagaaatactcatctagcgttcacgacccgaacggcgaatacatgttcatgcgagcggtaaacaccgcaaagaaatcacggttgaccgacgtaaccctt

SEQ ID NO: 1044 - DNA, 810 bp, Artificial Sequence
  PD-1 v201  (vCD8) ICOS_ICOS/CD28
gactccccagacaggccctggaacccccccaccttctccccagccctgctcgtggtgaccgaaggggacaacgccaccttcacctgcagcttctccaacacatcggagagcttccacgtgatctggcaccgcgaaagccccagcggccagacggacacactggccgccttccccgaggaccgcagccagcccggccaggactgccgcttccgtgtcacacaactgcccaacgggcgtgacttccacatgagcgtggtcagggcccggcgcaatgacagcggcacctacgtgtgtggggtgatctccctggcccccaagatccagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgacttctggctccccatcggatgcgctgcgttcgtcgttgtctgcattcttggatgcatccttatttgctggctgaccaaaaagaaatactcatctagcgttcacgacccgaacggcgaatacatgttcatgcgagcggtaaacaccgcaaagaaatcacggttgaccgacgtaacccttcggagtaagagaagccgcctcctccacagcgactacatgaatatgaccccgcgcaggccggggcctacaagaaagcattaccagccgtatgctccaccacgagattttgctgcttacaggagc

SEQ ID NO: 1045 - DNA, 813 bp, Artificial Sequence
  PD-1 v201  (vCD8) ICOS_ICOS/41BB
gactccccagacaggccctggaacccccccaccttctccccagccctgctcgtggtgaccgaaggggacaacgccaccttcacctgcagcttctccaacacatcggagagcttccacgtgatctggcaccgcgaaagccccagcggccagacggacacactggccgccttccccgaggaccgcagccagcccggccaggactgccgcttccgtgtcacacaactgcccaacgggcgtgacttccacatgagcgtggtcagggcccggcgcaatgacagcggcacctacgtgtgtggggtgatctccctggcccccaagatccagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgacttctggctccccatcggatgcgctgcgttcgtcgttgtctgcattcttggatgcatccttatttgctggctgaccaaaaagaaatactcatctagcgttcacgacccgaacggcgaatacatgttcatgcgagcggtaaacaccgcaaagaaatcacggttgaccgacgtaacccttaaacggggtagaaagaagctcctctacatattcaaacagccgtttatgagacccgttcagactacccaagaagaggatgggtgtagttgccgctttcccgaggaggaagagggaggatgtgaactg

SEQ ID NO: 1046 - DNA, 951 bp, Artificial Sequence
  PD-1 v201  (vCD8)CD28_CD28/ICOS/41BB
gactccccagacaggccctggaacccccccaccttctccccagccctgctcgtggtgaccgaaggggacaacgccaccttcacctgcagcttctccaacacatcggagagcttccacgtgatctggcaccgcgaaagccccagcggccagacggacacactggccgccttccccgaggaccgcagccagcccggccaggactgccgcttccgtgtcacacaactgcccaacgggcgtgacttccacatgagcgtggtcagggcccggcgcaatgacagcggcacctacgtgtgtggggtgatctccctggcccccaagatccagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgcggagtaagagaagccgcctcctccacagcgactacatgaatatgaccccgcgcaggccggggcctacaagaaagcattaccagccgtatgctccaccacgagattttgctgcttacaggagctgctggctgaccaaaaagaaatactcatctagcgttcacgacccgaacggcgaatacatgttcatgcgagcggtaaacaccgcaaagaaatcacggttgaccgacgtaacccttaaacggggtagaaagaagctcctctacatattcaaacagccgtttatgagacccgttcagactacccaagaagaggatgggtgtagttgccgctttcccgaggaggaagagggaggatgtgaactg

SEQ ID NO: 1047 - DNA, 600 bp, Artificial Sequence
  PD-1 v201  (vCD8)CD28_RSKS
gactccccagacaggccctggaacccccccaccttctccccagccctgctcgtggtgaccgaaggggacaacgccaccttcacctgcagcttctccaacacatcggagagcttccacgtgatctggcaccgcgaaagccccagcggccagacggacacactggccgccttccccgaggaccgcagccagcccggccaggactgccgcttccgtgtcacacaactgcccaacgggcgtgacttccacatgagcgtggtcagggcccggcgcaatgacagcggcacctacgtgtgtggggtgatctccctggcccccaagatccagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgcggagtaagtcc

SEQ ID NO: 1048 - DNA, 726 bp, Artificial Sequence
  PD-1 WT  (CD8) CD28_CD28
ccaggatggttcttagactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgcctgcgactgggtgctggtagtggtggggggggtcctggcctgctattctctgctcgtcacggtcgcctttatcattttttgggtgcggagtaagagaagccgcctcctccacagcgactacatgaatatgaccccgcgcaggccggggcctacaagaaagcattaccagccgtatgctccaccacgagattttgctgcttacaggagc

SEQ ID NO: 1049 - DNA, 852 bp, Artificial Sequence
  PD-1 WT  (CD8) CD28_CD28/41BB
ccaggatggttcttagactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgcctgcgactgggtgctggtagtggtggggggggtcctggcctgctattctctgctcgtcacggtcgcctttatcattttttgggtgcggagtaagagaagccgcctcctccacagcgactacatgaatatgaccccgcgcaggccggggcctacaagaaagcattaccagccgtatgctccaccacgagattttgctgcttacaggagcaaacggggtagaaagaagctcctctacatattcaaacagccgtttatgagacccgttcagactacccaagaagaggatgggtgtagttgccgctttcccgaggaggaagagggaggatgtgaactg

SEQ ID NO: 1050 - DNA, 840 bp, Artificial Sequence
  PD-1 WT  (CD8) CD28_CD28/ICOS
ccaggatggttcttagactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgcctgcgactgggtgctggtagtggtggggggggtcctggcctgctattctctgctcgtcacggtcgcctttatcattttttgggtgcggagtaagagaagccgcctcctccacagcgactacatgaatatgaccccgcgcaggccggggcctacaagaaagcattaccagccgtatgctccaccacgagattttgctgcttacaggagctgctggctgaccaaaaagaaatactcatctagcgttcacgacccgaacggcgaatacatgttcatgcgagcggtaaacaccgcaaagaaatcacggttgaccgacgtaaccctt

SEQ ID NO: 1051 - DNA, 966 bp, Artificial Sequence
  PD-1 WT  (CD8) CD28_CD28/ICOS/41BB
ccaggatggttcttagactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgcctgcgactgggtgctggtagtggtggggggggtcctggcctgctattctctgctcgtcacggtcgcctttatcattttttgggtgcggagtaagagaagccgcctcctccacagcgactacatgaatatgaccccgcgcaggccggggcctacaagaaagcattaccagccgtatgctccaccacgagattttgctgcttacaggagctgctggctgaccaaaaagaaatactcatctagcgttcacgacccgaacggcgaatacatgttcatgcgagcggtaaacaccgcaaagaaatcacggttgaccgacgtaacccttaaacggggtagaaagaagctcctctacatattcaaacagccgtttatgagacccgttcagactacccaagaagaggatgggtgtagttgccgctttcccgaggaggaagagggaggatgtgaactg

SEQ ID NO: 1052 - DNA, 615 bp, Artificial Sequence
  PD-1 WT  (CD8) CD28_RSKS
ccaggatggttcttagactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgcctgcgactgggtgctggtagtggtggggggggtcctggcctgctattctctgctcgtcacggtcgcctttatcattttttgggtgcggagtaagtcc

SEQ ID NO: 1053 - DNA, 726 bp, Artificial Sequence
  PD-1 WT  (vCD8) CD28_CD28
ccaggatggttcttagactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgcggagtaagagaagccgcctcctccacagcgactacatgaatatgaccccgcgcaggccggggcctacaagaaagcattaccagccgtatgctccaccacgagattttgctgcttacaggagc

SEQ ID NO: 1054 - DNA, 852 bp, Artificial Sequence
  PD-1 WT  (vCD8) CD28_CD28/41BB
ccaggatggttcttagactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgcggagtaagagaagccgcctcctccacagcgactacatgaatatgaccccgcgcaggccggggcctacaagaaagcattaccagccgtatgctccaccacgagattttgctgcttacaggagcaaacggggtagaaagaagctcctctacatattcaaacagccgtttatgagacccgttcagactacccaagaagaggatgggtgtagttgccgctttcccgaggaggaagagggaggatgtgaactg

SEQ ID NO: 1055 - DNA, 840 bp, Artificial Sequence
  PD-1 WT  (vCD8) CD28_CD28/ICOS
ccaggatggttcttagactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgcggagtaagagaagccgcctcctccacagcgactacatgaatatgaccccgcgcaggccggggcctacaagaaagcattaccagccgtatgctccaccacgagattttgctgcttacaggagctgctggctgaccaaaaagaaatactcatctagcgttcacgacccgaacggcgaatacatgttcatgcgagcggtaaacaccgcaaagaaatcacggttgaccgacgtaaccctt

SEQ ID NO: 1056 - DNA, 966 bp, Artificial Sequence
  PD-1 WT  (vCD8) CD28_CD28/ICOS/41BB
ccaggatggttcttagactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgcggagtaagagaagccgcctcctccacagcgactacatgaatatgaccccgcgcaggccggggcctacaagaaagcattaccagccgtatgctccaccacgagattttgctgcttacaggagctgctggctgaccaaaaagaaatactcatctagcgttcacgacccgaacggcgaatacatgttcatgcgagcggtaaacaccgcaaagaaatcacggttgaccgacgtaacccttaaacggggtagaaagaagctcctctacatattcaaacagccgtttatgagacccgttcagactacccaagaagaggatgggtgtagttgccgctttcccgaggaggaagagggaggatgtgaactg

SEQ ID NO: 1057 - DNA, 615 bp, Artificial Sequence
  PD-1 WT  (vCD8) CD28_RSKS
ccaggatggttcttagactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgcggagtaagtcc

SEQ ID NO: 1058 - DNA, 717 bp, Artificial Sequence
  PD-1 WT  (vCD8) CD28_ICOS
ccaggatggttcttagactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgtgctggctgaccaaaaagaaatactcatctagcgttcacgacccgaacggcgaatacatgttcatgcgagcggtaaacaccgcaaagaaatcacggttgaccgacgtaaccctt

SEQ ID NO: 1059 - DNA, 729 bp, Artificial Sequence
  PD-1 WT  (vCD8) CD28_41BB
ccaggatggttcttagactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgaaacggggtagaaagaagctcctctacatattcaaacagccgtttatgagacccgttcagactacccaagaagaggatgggtgtagttgccgctttcccgaggaggaagagggaggatgtgaactg

SEQ ID NO: 1060 - DNA, 843 bp, Artificial Sequence
  PD-1 WT  (vCD8) CD28_ICOS/41BB
ccaggatggttcttagactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgtgctggctgaccaaaaagaaatactcatctagcgttcacgacccgaacggcgaatacatgttcatgcgagcggtaaacaccgcaaagaaatcacggttgaccgacgtaacccttaaacggggtagaaagaagctcctctacatattcaaacagccgtttatgagacccgttcagactacccaagaagaggatgggtgtagttgccgctttcccgaggaggaagagggaggatgtgaactg

SEQ ID NO: 1061 - DNA, 843 bp, Artificial Sequence
  PD-1 WT  (vCD8) CD28_41BB/ICOS
ccaggatggttcttagactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgaaacggggtagaaagaagctcctctacatattcaaacagccgtttatgagacccgttcagactacccaagaagaggatgggtgtagttgccgctttcccgaggaggaagagggaggatgtgaactgtgctggctgaccaaaaagaaatactcatctagcgttcacgacccgaacggcgaatacatgttcatgcgagcggtaaacaccgcaaagaaatcacggttgaccgacgtaaccctt

SEQ ID NO: 1062 - DNA, 702 bp, Artificial Sequence
  PD-1 v201  (vCD8) CD28_ICOS
gactccccagacaggccctggaacccccccaccttctccccagccctgctcgtggtgaccgaaggggacaacgccaccttcacctgcagcttctccaacacatcggagagcttccacgtgatctggcaccgcgaaagccccagcggccagacggacacactggccgccttccccgaggaccgcagccagcccggccaggactgccgcttccgtgtcacacaactgcccaacgggcgtgacttccacatgagcgtggtcagggcccggcgcaatgacagcggcacctacgtgtgtggggtgatctccctggcccccaagatccagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtactggtagtggtggggggggtcctggcctgctattctctgctcgtcacggtcgcctttatcattttttgggtgtgctggctgaccaaaaagaaatactcatctagcgttcacgacccgaacggcgaatacatgttcatgcgagcggtaaacaccgcaaagaaatcacggttgaccgacgtaaccctt

SEQ ID NO: 1063 - DNA, 714 bp, Artificial Sequence
  PD-1 v201  (vCD8) CD28_41BB
gactccccagacaggccctggaacccccccaccttctccccagccctgctcgtggtgaccgaaggggacaacgccaccttcacctgcagcttctccaacacatcggagagcttccacgtgatctggcaccgcgaaagccccagcggccagacggacacactggccgccttccccgaggaccgcagccagcccggccaggactgccgcttccgtgtcacacaactgcccaacgggcgtgacttccacatgagcgtggtcagggcccggcgcaatgacagcggcacctacgtgtgtggggtgatctccctggcccccaagatccagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgaaacggggtagaaagaagctcctctacatattcaaacagccgtttatgagacccgttcagactacccaagaagaggatgggtgtagttgccgctttcccgaggaggaagagggaggatgtgaactg

SEQ ID NO: 1064 - DNA, 828 bp, Artificial Sequence
  PD-1 v201  (vCD8) CD28_ICOS/41BB
gactccccagacaggccctggaacccccccaccttctccccagccctgctcgtggtgaccgaaggggacaacgccaccttcacctgcagcttctccaacacatcggagagcttccacgtgatctggcaccgcgaaagccccagcggccagacggacacactggccgccttccccgaggaccgcagccagcccggccaggactgccgcttccgtgtcacacaactgcccaacgggcgtgacttccacatgagcgtggtcagggcccggcgcaatgacagcggcacctacgtgtgtggggtgatctccctggcccccaagatccagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgtgctggctgaccaaaaagaaatactcatctagcgttcacgacccgaacggcgaatacatgttcatgcgagcggtaaacaccgcaaagaaatcacggttgaccgacgtaacccttaaacggggtagaaagaagctcctctacatattcaaacagccgtttatgagacccgttcagactacccaagaagaggatgggtgtagttgccgctttcccgaggaggaagagggaggatgtgaactg

SEQ ID NO: 1065 - DNA, 828 bp, Artificial Sequence
  PD-1 v201  (vCD8) CD28_41BB/ICOS
gactccccagacaggccctggaacccccccaccttctccccagccctgctcgtggtgaccgaaggggacaacgccaccttcacctgcagcttctccaacacatcggagagcttccacgtgatctggcaccgcgaaagccccagcggccagacggacacactggccgccttccccgaggaccgcagccagcccggccaggactgccgcttccgtgtcacacaactgcccaacgggcgtgacttccacatgagcgtggtcagggcccggcgcaatgacagcggcacctacgtgtgtggggtgatctccctggcccccaagatccagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgaaacggggtagaaagaagctcctctacatattcaaacagccgtttatgagacccgttcagactacccaagaagaggatgggtgtagttgccgctttcccgaggaggaagagggaggatgtgaactgtgctggctgaccaaaaagaaatactcatctagcgttcacgacccgaacggcgaatacatgttcatgcgagcggtaaacaccgcaaagaaatcacggttgaccgacgtaaccctt

SEQ ID NO: 1066 - DNA, 711 bp, Artificial Sequence
  PD-1 v196  (vCD8) CD28_CD28
gactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcaaccagcccggccaggaccgccgcttccgtgtcacacaactgcccaacgggcgtgactaccacatgagcgtggacagggcccggcgcaatgacagcggcacatacctctgtggggccatcactctggcccccaaggtgcagatcgatgagagcctgcgtgtagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgcggagtaagagaagccgcctcctccacagcgactacatgaatatgaccccgcgcaggccggggcctacaagaaagcattaccagccgtatgctccaccacgagattttgctgcttacaggagc

SEQ ID NO: 1067 - DNA, 837 bp, Artificial Sequence
  PD-1 v196  (vCD8) CD28_CD28/41BB
gactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcaaccagcccggccaggaccgccgcttccgtgtcacacaactgcccaacgggcgtgactaccacatgagcgtggacagggcccggcgcaatgacagcggcacatacctctgtggggccatcactctggcccccaaggtgcagatcgatgagagcctgcgtgtagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgcggagtaagagaagccgcctcctccacagcgactacatgaatatgaccccgcgcaggccggggcctacaagaaagcattaccagccgtatgctccaccacgagattttgctgcttacaggagcaaacggggtagaaagaagctcctctacatattcaaacagccgtttatgagacccgttcagactacccaagaagaggatgggtgtagttgccgctttcccgaggaggaagagggaggatgtgaactg

SEQ ID NO: 1068 - DNA, 825 bp, Artificial Sequence
  PD-1 v196  (vCD8) CD28_CD28/ICOS
gactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcaaccagcccggccaggaccgccgcttccgtgtcacacaactgcccaacgggcgtgactaccacatgagcgtggacagggcccggcgcaatgacagcggcacatacctctgtggggccatcactctggcccccaaggtgcagatcgatgagagcctgcgtgtagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgcggagtaagagaagccgcctcctccacagcgactacatgaatatgaccccgcgcaggccggggcctacaagaaagcattaccagccgtatgctccaccacgagattttgctgcttacaggagctgctggctgaccaaaaagaaatactcatctagcgttcacgacccgaacggcgaatacatgttcatgcgagcggtaaacaccgcaaagaaatcacggttgaccgacgtaaccctt

SEQ ID NO: 1069 - DNA, 951 bp, Artificial Sequence
  PD-1 v196  (vCD8) CD28_CD28/ICOS/41BB
gactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcaaccagcccggccaggaccgccgcttccgtgtcacacaactgcccaacgggcgtgactaccacatgagcgtggacagggcccggcgcaatgacagcggcacatacctctgtggggccatcactctggcccccaaggtgcagatcgatgagagcctgcgtgtagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgcggagtaagagaagccgcctcctccacagcgactacatgaatatgaccccgcgcaggccggggcctacaagaaagcattaccagccgtatgctccaccacgagattttgctgcttacaggagctgctggctgaccaaaaagaaatactcatctagcgttcacgacccgaacggcgaatacatgttcatgcgagcggtaaacaccgcaaagaaatcacggttgaccgacgtaacccttaaacggggtagaaagaagctcctctacatattcaaacagccgtttatgagacccgttcagactacccaagaagaggatgggtgtagttgccgctttcccgaggaggaagagggaggatgtgaactg

SEQ ID NO: 1070 - DNA, 702 bp, Artificial Sequence
  PD-1 v196  (vCD8) CD28_ICOS
gactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcaaccagcccggccaggaccgccgcttccgtgtcacacaactgcccaacgggcgtgactaccacatgagcgtggacagggcccggcgcaatgacagcggcacatacctctgtggggccatcactctggcccccaaggtgcagatcgatgagagcctgcgtgtagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgtgctggctgaccaaaaagaaatactcatctagcgttcacgacccgaacggcgaatacatgttcatgcgagcggtaaacaccgcaaagaaatcacggttgaccgacgtaaccctt

SEQ ID NO: 1071 - DNA, 714 bp, Artificial Sequence
  PD-1 v196  (vCD8) CD28_41BB
gactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcaaccagcccggccaggaccgccgcttccgtgtcacacaactgcccaacgggcgtgactaccacatgagcgtggacagggcccggcgcaatgacagcggcacatacctctgtggggccatcactctggcccccaaggtgcagatcgatgagagcctgcgtgtagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgaaacggggtagaaagaagctcctctacatattcaaacagccgtttatgagacccgttcagactacccaagaagaggatgggtgtagttgccgctttcccgaggaggaagagggaggatgtgaactg

SEQ ID NO: 1072 - DNA, 828 bp, Artificial Sequence
  PD-1 v196  (vCD8) CD28_ICOS/41BB
gactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcaaccagcccggccaggaccgccgcttccgtgtcacacaactgcccaacgggcgtgactaccacatgagcgtggacagggcccggcgcaatgacagcggcacatacctctgtggggccatcactctggcccccaaggtgcagatcgatgagagcctgcgtgtagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgtgctggctgaccaaaaagaaatactcatctagcgttcacgacccgaacggcgaatacatgttcatgcgagcggtaaacaccgcaaagaaatcacggttgaccgacgtaacccttaaacggggtagaaagaagctcctctacatattcaaacagccgtttatgagacccgttcagactacccaagaagaggatgggtgtagttgccgctttcccgaggaggaagagggaggatgtgaactg

SEQ ID NO: 1073 - DNA, 828 bp, Artificial Sequence
  PD-1 v196  (vCD8) CD28_41BB/ICOS
gactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcaaccagcccggccaggaccgccgcttccgtgtcacacaactgcccaacgggcgtgactaccacatgagcgtggacagggcccggcgcaatgacagcggcacatacctctgtggggccatcactctggcccccaaggtgcagatcgatgagagcctgcgtgtagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgaaacggggtagaaagaagctcctctacatattcaaacagccgtttatgagacccgttcagactacccaagaagaggatgggtgtagttgccgctttcccgaggaggaagagggaggatgtgaactgtgctggctgaccaaaaagaaatactcatctagcgttcacgacccgaacggcgaatacatgttcatgcgagcggtaaacaccgcaaagaaatcacggttgaccgacgtaaccctt

SEQ ID NO: 1074 - DNA, 717 bp, Artificial Sequence
  PD-1 v196  (vCD8) 41BB_41BB
gactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcaaccagcccggccaggaccgccgcttccgtgtcacacaactgcccaacgggcgtgactaccacatgagcgtggacagggcccggcgcaatgacagcggcacatacctctgtggggccatcactctggcccccaaggtgcagatcgatgagagcctgcgtgtagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgacatcatatcattcttcttggctctgacctctacagctctgctgttccttttgttttttctcacactccgcttttctgtagttaaacggggtagaaagaagctcctctacatattcaaacagccgtttatgagacccgttcagactacccaagaagaggatgggtgtagttgccgctttcccgaggaggaagagggaggatgtgaactg

SEQ ID NO: 1075 - DNA, 687 bp, Artificial Sequence
  PD-1 v196  (vCD8) ICOS_ICOS
gactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcaaccagcccggccaggaccgccgcttccgtgtcacacaactgcccaacgggcgtgactaccacatgagcgtggacagggcccggcgcaatgacagcggcacatacctctgtggggccatcactctggcccccaaggtgcagatcgatgagagcctgcgtgtagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgacttctggctccccatcggatgcgctgcgttcgtcgttgtctgcattcttggatgcatccttatttgctggctgaccaaaaagaaatactcatctagcgttcacgacccgaacggcgaatacatgttcatgcgagcggtaaacaccgcaaagaaatcacggttgaccgacgtaaccctt

SEQ ID NO: 1076 - DNA, 600 bp, Artificial Sequence
  PD-1 v196  (vCD8) CD28_RSKS
gactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcaaccagcccggccaggaccgccgcttccgtgtcacacaactgcccaacgggcgtgactaccacatgagcgtggacagggcccggcgcaatgacagcggcacatacctctgtggggccatcactctggcccccaaggtgcagatcgatgagagcctgcgtgtagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgcggagtaagtcc

SEQ ID NO: 1077 - DNA, 711 bp, Artificial Sequence
  PD-1 v196  (CD8) CD28_CD28
gactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcaaccagcccggccaggaccgccgcttccgtgtcacacaactgcccaacgggcgtgactaccacatgagcgtggacagggcccggcgcaatgacagcggcacatacctctgtggggccatcactctggcccccaaggtgcagatcgatgagagcctgcgtgtagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgcctgcgactgggtgctggtagtggtggggggggtcctggcctgctattctctgctcgtcacggtcgcctttatcattttttgggtgcggagtaagagaagccgcctcctccacagcgactacatgaatatgaccccgcgcaggccggggcctacaagaaagcattaccagccgtatgctccaccacgagattttgctgcttacaggagc

SEQ ID NO: 1078 - DNA, 837 bp, Artificial Sequence
  PD-1 v196  (CD8) CD28_CD28/41BB
gactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcaaccagcccggccaggaccgccgcttccgtgtcacacaactgcccaacgggcgtgactaccacatgagcgtggacagggcccggcgcaatgacagcggcacatacctctgtggggccatcactctggcccccaaggtgcagatcgatgagagcctgcgtgtagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgcctgcgactgggtgctggtagtggtggggggggtcctggcctgctattctctgctcgtcacggtcgcctttatcattttttgggtgcggagtaagagaagccgcctcctccacagcgactacatgaatatgaccccgcgcaggccggggcctacaagaaagcattaccagccgtatgctccaccacgagattttgctgcttacaggagcaaacggggtagaaagaagctcctctacatattcaaacagccgtttatgagacccgttcagactacccaagaagaggatgggtgtagttgccgctttcccgaggaggaagagggaggatgtgaactg

SEQ ID NO: 1079 - DNA, 825 bp, Artificial Sequence
  PD-1 v196  (CD8) CD28_CD28/ICOS
gactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcaaccagcccggccaggaccgccgcttccgtgtcacacaactgcccaacgggcgtgactaccacatgagcgtggacagggcccggcgcaatgacagcggcacatacctctgtggggccatcactctggcccccaaggtgcagatcgatgagagcctgcgtgtagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgcctgcgactgggtgctggtagtggtggggggggtcctggcctgctattctctgctcgtcacggtcgcctttatcattttttgggtgcggagtaagagaagccgcctcctccacagcgactacatgaatatgaccccgcgcaggccggggcctacaagaaagcattaccagccgtatgctccaccacgagattttgctgcttacaggagctgctggctgaccaaaaagaaatactcatctagcgttcacgacccgaacggcgaatacatgttcatgcgagcggtaaacaccgcaaagaaatcacggttgaccgacgtaaccctt

SEQ ID NO: 1080 - DNA, 951 bp, Artificial Sequence
  PD-1 v196  (CD8) CD28_CD28/ICOS/41BB
gactccccagacaggccctggaacccccccaccttctccccagccctgctcgtggtgaccgaaggggacaacgccaccttcacctgcagcttctccaacacatcggagagcttcgtgctaaactggtatcgcatgagccccagcaaccagacggacaagctggccgccttccccgaggaccgcaaccagcccggccaggaccgccgcttccgtgtcacacaactgcccaacgggcgtgactaccacatgagcgtggacagggcccggcgcaatgacagcggcacatacctctgtggggccatcactctggcccccaaggtgcagatcgatgagagcctgcgtgtagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgcctgcgactgggtgctggtagtggtggggggggtcctggcctgctattctctgctcgtcacggtcgcctttatcattttttgggtgcggagtaagagaagccgcctcctccacagcgactacatgaatatgaccccgcgcaggccggggcctacaagaaagcattaccagccgtatgctccaccacgagattttgctgcttacaggagctgctggctgaccaaaaagaaatactcatctagcgttcacgacccgaacggcgaatacatgttcatgcgagcggtaaacaccgcaaagaaatcacggttgaccgacgtaacccttaaacggggtagaaagaagctcctctacatattcaaacagccgtttatgagacccgttcagactacccaagaagaggatgggtgtagttgccgctttcccgaggaggaagagggaggatgtgaactg

SEQ ID NO: 1081 - protein, 234 aa, Artificial Sequence
  PD-1 v201 (vCD8) 41BB_41BB
DSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERAKPTTTPAPRPPTPAPTIASQPLSLRPEACRPAAGGAVHTRGLDFACDIISFFLALTSTALLFLLFFLTLRFSVVKRGRKKLLYIFKQPFMRPVQTTQEEDGCSCRFPEEEE

SEQ ID NO: 1082 - protein, 274 aa, Artificial Sequence
  PD-1 v201 (vCD8) CD28_CD28/41BB
DSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERAKPTTTPAPRPPTPAPTIASQPLSLRPEACRPAAGGAVHTRGLDFASDWVLVVVGGVLACYSLLVTVAFIIFWVRSKRSRLLHSDYMNMTPRRPGPTRKHYQPYAPPRDFAAYRSKRGRKKLLYIFKQPFMRPVQTTQEEDGCSCRFPEEEE

SEQ ID NO: 1083 - protein, 275 aa, Artificial Sequence
  PD-1 v201 (vCD8) 41BB_41BB/CD28
DSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERAKPTTTPAPRPPTPAPTIASQPLSLRPEACRPAAGGAVHTRGLDFASDIISFFLALTSTALLFLLFFLTLRFSVVKRGRKKLLYIFKQPFMRPVQTTQEEDGCSCRFPEEEERSKRSRLLHSDYMNMTPRRPGPTRKHYQPYAPPRDFAAYRS

SEQ ID NO: 1084 - protein, 266 aa, Artificial Sequence
  PD-1 v201 (vCD8) ICOS_ICOS/41BB
DSPDRPWNPPTFSPALLVVTEGDNATFTCSFSNTSESFHVIWHRESPSGQTDTLAAFPEDRSQPGQDCRFRVTQLPNGRDFHMSVVRARRNDSGTYVCGVISLAPKIQIKESLRAELRVTERAKPTTTPAPRPPTPAPTIASQPLSLRPEACRPAAGGAVHTRGLDFASDFWLPIGCAAFVVVCILGCILICWLTKKKYSSSVHDPNGEYMFMRAVNTAKKSRLTDVTLKRGRKKLLYIFKQPFMRPVQTTQEEDGCSCRFPEEEE

SEQ ID NO: 1085 - DNA, 702 bp, Artificial Sequence
  PD-1 v201 (vCD8) 41BB_41BB
gactccccagacaggccctggaacccccccaccttctccccagccctgctcgtggtgaccgaaggggacaacgccaccttcacctgcagcttctccaacacatcggagagcttccacgtgatctggcaccgcgaaagccccagcggccagacggacacactggccgccttccccgaggaccgcagccagcccggccaggactgccgcttccgtgtcacacaactgcccaacgggcgtgacttccacatgagcgtggtcagggcccggcgcaatgacagcggcacctacgtgtgtggggtgatctccctggcccccaagatccagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtgcacaccagaggactggatttcgcctgcgacatcatatcattcttcttggctctgacctctacagctctgctgttccttttgttttttctcacactccgcttttctgtagttaaacggggtagaaagaagctcctctacatattcaaacagccgtttatgagacccgttcagactacccaagaagaggatgggtgtagttgccgctttcccgaggaggaagag

SEQ ID NO: 1086 - DNA, 822 bp, Artificial Sequence
  PD-1 v201 (vCD8) CD28_CD28/41BB
gactccccagacaggccctggaacccccccaccttctccccagccctgctcgtggtgaccgaaggggacaacgccaccttcacctgcagcttctccaacacatcggagagcttccacgtgatctggcaccgcgaaagccccagcggccagacggacacactggccgccttccccgaggaccgcagccagcccggccaggactgccgcttccgtgtcacacaactgcccaacgggcgtgacttccacatgagcgtggtcagggcccggcgcaatgacagcggcacctacgtgtgtggggtgatctccctggcccccaagatccagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgactgggtgctggtagtggtggggggggtcctggcctgctattctctgctcgtcacggtcgcctttatcattttttgggtgcggagtaagagaagccgcctcctccacagcgactacatgaatatgaccccgcgcaggccggggcctacaagaaagcattaccagccgtatgctccaccacgagattttgctgcttacaggagcaaacggggtagaaagaagctcctctacatattcaaacagccgtttatgagacccgttcagactacccaagaagaggatgggtgtagttgccgctttcccgaggaggaagag

SEQ ID NO: 1087 - DNA, 831 bp, Artificial Sequence
  PD-1 v201 (vCD8) 41BB_41BB/CD28
gactccccagacaggccctggaacccccccaccttctccccagccctgctcgtggtgaccgaaggggacaacgccaccttcacctgcagcttctccaacacatcggagagcttccacgtgatctggcaccgcgaaagccccagcggccagacggacacactggccgccttccccgaggaccgcagccagcccggccaggactgccgcttccgtgtcacacaactgcccaacgggcgtgacttccacatgagcgtggtcagggcccggcgcaatgacagcggcacctacgtgtgtggggtgatctccctggcccccaagatccagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtacacaccagaggactggatttcgccagcgacccgcagatcatatcattcttcttggctctgacctctacagctctgctgttccttttgttttttctcacactccgcttttctgtagttaaacggggtagaaagaagctcctctacatattcaaacagccgtttatgagacccgttcagactacccaagaagaggatgggtgtagttgccgctttcccgaggaggaagagcggagtaagagaagccgcctcctccacagcgactacatgaatatgaccccgcgcaggccggggcctacaagaaagcattaccagccgtatgctccaccacgagattttgctgcttacaggagc

SEQ ID NO: 1088 - DNA, 804 bp, Artificial Sequence
  PD-1 v201 (vCD8) ICOS_ICOS/41BB
gactccccagacaggccctggaacccccccaccttctccccagccctgctcgtggtgaccgaaggggacaacgccaccttcacctgcagcttctccaacacatcggagagcttccacgtgatctggcaccgcgaaagccccagcggccagacggacacactggccgccttccccgaggaccgcagccagcccggccaggactgccgcttccgtgtcacacaactgcccaacgggcgtgacttccacatgagcgtggtcagggcccggcgcaatgacagcggcacctacgtgtgtggggtgatctccctggcccccaagatccagatcaaagagagcctgcgggcagagctcagggtgacagagagagccaagcctaccaccacccctgcccctagacctccaacacccgccccaacaatcgccagccagcctctgtctctgaggcccgaggcttgtagaccagctgctggcggagccgtgcacaccagaggactggatttcgcctgcgacttgaaattctggctccccatcggatgcgctgcgttcgtcgttgtctgcattcttggatgcatccttatttgctggctgaccaaaaagaaatactcatctagcgttcacgacccgaacggcgaatacatgttcatgcgagcggtaaacaccgcaaagaaatcacggttgaccgacgtaacccttaaacggggtagaaagaagctcctctacatattcaaacagccgtttatgagacccgttcagactacccaagaagaggatgggtgtagttgccgctttcccgaggaggaagag

SEQ ID NO: 1089 - protein, 361 aa, Artificial Sequence
  CD86 WT ECD/PD1v179 ECD (6-127) Stack v1
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPGGGGSGGGGSGGGGSDSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTER

SEQ ID NO: 1090 - protein, 361 aa, Artificial Sequence
  CD86 ECD v1 /PD1v179 ECD (6-127) Stack v2
APLKIQAYFNETVDLPCQFANSQNLSLSELVVFWQDQENLVLNEVYLGKEKFDSVHSKYMGRTSFDSDSWTLRLHNLQIKDKGLYQCIILHKKPTGMIRIHQMNSELSVLANFSQPEIVPISNITENVYINLTCSSIHGYPEPKKMSVLLRTKNSTIEYDGVMQKSQDNVTELYDVSISLPVSFPDVTSNMTIFCIMETDKTRLLTSPFSIELEDPQPPPDHIPGGGGSGGGGSGGGGSDSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTER

SEQ ID NO: 1091 - protein, 361 aa, Artificial Sequence
  CD86 ECD v2 /PD1v179 ECD (6-127) Stack v3
APLKIQAYFNETADLPCQFANSQNLSLSELVVFWQDQENLVLNEVYLGKEKFDSVHSKYMGRTSFDSDSWTLRLHNLQIKDKGLYQCIILHKTPTGLIRIHQMNSELSVLANFSQPEIVPISNITENVYINLACSSIHGYPEPKKMSVLLRTKNSTIEYDGVMQKSQDNVTELYDVSISLPVSFPDVTSNMTIFCILETDKTRLLSSPFSIELEVPQPPPDHIPGGGGSGGGGSGGGGSDSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTER

SEQ ID NO: 1092 - protein, 361 aa, Artificial Sequence
  CD86 ECD v3 /PD1v179 ECD (6-127) Stack v4
APLKIQAYFNETADLPCQFANSQNLSLSELVVFWQDQENLVLNEVYLGKEKFDSVHSKYMGRTSFDSDSWTLRLHNLQIKDKGLYRCIILHKKPTGMIRIHQMSSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPGGGGSGGGGSGGGGSDSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTER

SEQ ID NO: 1093 - protein, 248 aa, Artificial Sequence
  CD86 IgV v4 /PD1v179 ECD (6-127) Stack v5
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLAGGGGSGGGGSGGGGSDSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTER

SEQ ID NO: 1094 - protein, 248 aa, Artificial Sequence
  CD86 IgV v5 /PD1v179 ECD (6-127) Stack v6
APLKIQAYFNETVDLPCQFANSQNLSLSELVVFWQDQENLVLNEVYLGKEKFDSVHSKYMGRTSFDSDSWTLRLHNLQIKDKGLYQCIILHKKPTGMIRIHQMNSELSVLAGGGGSGGGGSGGGGSDSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTER

SEQ ID NO: 1095 - protein, 248 aa, Artificial Sequence
  CD86 IgV v6 /PD1v179 ECD (6-127) Stack v7
APLKIQAYFNETADLPCQFANSQNLSLSELVVFWQDQENLVLNEVYLGKEKFDSVHSKYMGRTSFDSDSWTLRLHNLQIKDKGLYQCIILHKTPTGLIRIHQMNSELSVLAGGGGSGGGGSGGGGSDSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTER

SEQ ID NO: 1096 - protein, 248 aa, Artificial Sequence
  CD86 IgV v7 /PD1v179 ECD (6-127) Stack v8
APLKIQAYFNETADLPCQFANSQNLSLSELVVFWQDQENLVLNEVYLGKEKFDSVHSKYMGRTSFDSDSWTLRLHNLQIKDKGLYRCIILHKKPTGMIRIHQMSSELSVLAGGGGSGGGGSGGGGSDSPDRPWNPPTFSPALLVVTEGDNATFTCSFSNTSESFVLNWYRMSPSNQTDKLAAFPEDRNQPGQDRRFRVTQLPNGRDYHMSVDRARRNDSGTYLCGAITLAPKVQIDESLRVELRVTER

SEQ ID NO: 1097 - protein, 224 aa, Artificial Sequence
  CD86 ECD v5
APLKIQAYFNETVDLPCQFANSQNLSLSELVVFWQDQENLVLNEVYLGKEKFDSVHSKYMGRTSFDSDSWTLRLHNLQIKDKGLYQCIILHKKPTGMIRIHQMNSELSVLANFSQPEIVPISNITENVYINLTCSSIHGYPEPKKMSVLLRTKNSTIEYDGVMQKSQDNVTELYDVSISLPVSFPDVTSNMTIFCIMETDKTRLLTSPFSIELEDPQPPPDHIP

SEQ ID NO: 1098 - protein, 224 aa, Artificial Sequence
  CD86 ECD v9
APLKIQAYFNETADLPCQFANSQNLSLSELVVFWQDQENLVLNEVYLGKEKFDSVHSKYMGRTSFDSDSWTLRLHNLQIKDKGLYQCIILHKTPTGLIRIHQMNSELSVLANFSQPEIVPISNITENVYINLACSSIHGYPEPKKMSVLLRTKNSTIEYDGVMQKSQDNVTELYDVSISLPVSFPDVTSNMTIFCILETDKTRLLSSPFSIELEVPQPPPDHIP

SEQ ID NO: 1099 - protein, 224 aa, Artificial Sequence
  CD86 ECD v10
APLKIQAYFNETADLPCQFANSQNLSLSELVVFWQDQENLVLNEVYLGKEKFDSVHSKYMGRTSFDSDSWTLRLHNLQIKDKGLYRCIILHKKPTGMIRIHQMSSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 1100 - protein, 111 aa, Artificial Sequence
  CD86(B7-2) IgV (24-134)
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLA

SEQ ID NO: 1101 - protein, 111 aa, Artificial Sequence
  CD86 IgV v55
APLKIQAYFNETVDLPCQFANSQNLSLSELVVFWQDQENLVLNEVYLGKEKFDSVHSKYMGRTSFDSDSWTLRLHNLQIKDKGLYQCIILHKKPTGMIRIHQMNSELSVLA

SEQ ID NO: 1102 - protein, 111 aa, Artificial Sequence
  CD86 IgV v59
APLKIQAYFNETADLPCQFANSQNLSLSELVVFWQDQENLVLNEVYLGKEKFDSVHSKYMGRTSFDSDSWTLRLHNLQIKDKGLYQCIILHKTPTGLIRIHQMNSELSVLA

SEQ ID NO: 1103 - protein, 111 aa, Artificial Sequence
  CD86 IgV v60
APLKIQAYFNETADLPCQFANSQNLSLSELVVFWQDQENLVLNEVYLGKEKFDSVHSKYMGRTSFDSDSWTLRLHNLQIKDKGLYRCIILHKKPTGMIRIHQMSSELSVLA

SEQ ID NO: 1104 - protein, 99 aa, Artificial Sequence
  CD86(B7-2) IgV WT
NETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELS

What is claimed:

1. A variant PD-1 polypeptide comprising an IgV domain, wherein:
   (a) the variant PD-1 polypeptide comprises one or more amino acid substitutions in an unmodified PD-1 polypeptide selected from the amino acid substitutions P8T, D9E, D9G, D9N, D9V, P11A, W12G, W12L, W12R, N13Y, P14H, P14L, P14S, T16A, T16I, T16S, F17I, F17V, F17Y, S18T, A20S, A20T, A20V, L21V, L22I, V23E, V23G, V24L, D28E, N29D, T31I, T31N, T31S, T33I, C34Y, S35N, F36I, F36L, F36Y, S37P, S37T, N38S, N38T, T39R, T39S, S40P, S40T, E41D, E41V, S42G, S42R, F43L, F43Y, V44M, Y48N, M50T, S51G, P52A, P52L, S53T, N54H, Q55R, T56M, T56P, T56S, K58R, L59M, L59R, L59V, E64D, E64K, R66H, R66S, S67C, S67I, S67N, S67R, P69H, G70C, G70E, G70S, Q71H, Q71K, Q71L, D72N, C73A, C73G, C73H, C73P, C73Y, F75Y, R76H, R76S, V77D, T78S, Q79P, L80Q, P81S, R84H, R84Q, D85G, D85N, F86Y, H87L, S89G, S89N, V90L, V90M, V91A, V91D, V91I, R92N, R92S, A93V, R94Q, R95L, N96T, T100A, T100I, T100S, L102F, G104A, G104T, G104V, A105C, A105G, A105L, I106L, L108T, A109G, K111M, K111N, Q113R, Q113W, I114T, K115D, K115E, K115I, K115N, K115Q, E116D, R119H, R119L, R119P, R119Q, R119W, T125K, T125S, R127S, R128M, A129S, E130K, V131A, V131E, P132H, P132R, P132S, P132T, T133A, T133R, T133S, A134D, A134V, H135N, H135R, H135Y, P136L, P136T, S137C, P138S, P138T, S139P, P140A, P140L, P140R, R141G, R141M, R141S, R141W, P142A, P142L, P142R, P142T, A143D, A143S, A143V, G144D, or G144S with reference to numbering of positions set forth in SEQ ID NO:37; or
   (b) the variant PD-1 polypeptide comprises two or more amino acid substitutions in an unmodified PD-1 polypeptide selected from C73A, C73G, C73H, C73P, C73R, C73S, C73Y, F86Y, S107T, A112V, K115D, K115E, K115I, K115N, K115Q, R119H, R119L, R119P, R119Q, R119W or A120V, with reference to numbering of positions set forth in SEQ ID NO:37; wherein the unmodified PD-1 polypeptide comprises (i) the sequence of amino acids set forth in any of SEQ ID NOS: 37, 244, or 392, (ii) a sequence of amino acids that has at least 95% sequence identity to any of SEQ ID NOS:37, 244, or 392; or (iii) is a portion of (i) or (ii) comprising an IgV domain.

2. The variant PD-1 polypeptide of claim 1, wherein the one or more amino acid substitutions or the two or more amino acid substitutions are selected from A112V/R119L/A120V; N13S/A120V/P142A; C34Y/N54D/T100S/A112V/A120V; M50V/S67N/L80Q/A120V/A143S; A112V/R119W; R84H/H87L/A112V/R119W; Q71R/V91I/A112V/R119L/A120V/T125S; A112V/K115E; M50L/L59V/R66H/A112V/H135Y/P138T/P142L; R119W; S53G/Q55R/A112V/K115E/A120V/S139T; R119W/H135R; A120V/T125I; A112V/A120V/V131A; F17I/K111E/A112V/A120V; S18T/R119Q/R141M; F36L/S37T/A112V/H135N/P138S; A112V/T125I; M50I/A112V/A120V; S67N/C73R/A93V/A112V/A120V; D72G/A112V/A120V; N96D/A112V/A120V/T125S; F86Y/R119W/T125I; R119P/T133R; K111M/A112V/K115E/P132H; S67G/A112V/T125I/T133S; A112V/A120V; S37P/A112V/R119W; W12L/S37P/A112V/R119W; D9G/A112V/A120V; T31S/S37T/A112V/T125I/A143S; S37T/A112V/T125I; R92G/A112V/A120V; E64D/F86Y/A112V/A120V; H87R/A112V/R119W; N13D/A105V/A112V/A120V/A134D; A112V/R119L/A120V/S137C; T16I/M50I/A112V/A120V; M50L/A112V/R119Q/A120V/T125I/H135R; D57V/A112V; S67N/R119W; S67N/A112V/A120V; N54Y/A112V/P140A; F43Y/P69L/R119W; N54Y/A112V/R119W; T56M/C73S/R76H/A112V/R119L/A120V/P132T/R141W; F17I/S40P/E41D/S67N/R95L/A112V/A120V/T125I/R141M; F17L/T31S/S35N/P81S/N96S/A112V/R119W; F43L/S67N/C73R/A112V/A120V; W12L/N38D/A112V/R119Q/A120V/P142T; S67N/P69H/C73R/Q79P/V91D/A112V/A120V/P136T/A143D; F17I/S40P/S67N/Q79R/A112V/R119W/T125I; F43Y/M50V/S67N/C73R/R92G/A112V/A120V/P136T; F17L/T56M/S67N/A112V/R119W/A120V/P142R; W12L/N54Y/S67N/F75Y/V91D/R95L/G104A/A112V/R119W/R141M; F17L/S37T/S67N/T78S/F86Y/A112V/R119H/A120V/V131E/A143V; N13D/S40P/A112V/R119L/A120V/S137C; F17V/A30V/E41V/R76S/A112V/R119Q/A120V/V131A; F17I/T25A/M50V/S53T/R66S/S67R/S107T/A112V/R119W/A143V; N13D/S40P/S67N/C73R/R95L/G104A/A112V/A120V; S40P/

T56A/S67N/C73R/A112V/R119Q/A120V/V131A; N13Y/S40P/F43L/Q68P/R92G/A112V/R119L/A120V; F17I/S67N/Q71L/C73S/A112V/R119Q/A120V/P142L; F17I/S40P/P69S/C73R/N96S/G104A/A112V/A120V; F17I/S40P/A112V/R119L/A120V/P140R; A112V/A120V/T133S; A20S/S67N/C73R/R94Q/A112V/R119Q/A120V/T125I/P132S; N13D/S67N/C73R/R95L/A112V/R119Q/A120V/T125I; S40P/S67N/C73R/N96T/A112V/A120V; L21V/S40P/R95L/G104A/A112V/A120V/A129S/V131A/R141G; P14S/S40P/S42R/P52A/T56M/A112V/R119W/T125I/P142A; S40P/F43L/T56A/S67N/C73S/A112V/R119L/A120V; F17I/S40P/M50V/S67N/C73S/R95L/G104A/A112V/R119L/A120V; S40P/T56M/C73S/R95L/A112V/R119W/T125I/V131A/R141W; F171/A20V/S51G/N54D/F86Y/A112V/A120V/T125I; F17I/T31N/T56M/S67N/C73R/G104A/A112V/R119Q/A120V/T133A/P140L; F17V/S40P/R92G/R95L/A112V/R119W; W12G/F17L/T56V/S67N/A112V/R119W/V131E/R141S; F86Y/R92G/A112V/R119L/A120V/T125K/T133S; P8T/F17I/S67N/F86Y/G104A/A112V/A120V/S139T; F17I/S40P/A112V/R119W/G144D L22I/S67I/G70S/Q71R/S107T/A112V/R119L/A120V/T125I/T133S; S40P/A112V/A120V; T16S/S67N/C73R/A112V/R119W; N13D/S40P/A112V/A120V/T125I/T133S; M50L/V91D/A112V/R119W/P132R/R141G; F17I/S40P/M50I/S67R/A112V/R119L/A120V/S137C; S40P/A112V/R119W; F17I/V24L/A112V/R119W; S40P/S67N/C73R/A93V/A112V/A120V; N13D/F17I/A112V/R119W/R141M; S67N/C73R/A112V/A120V/R141S; W12R/L59V/R66H/F86Y/V90L/A112V/K115N/R119L/A120V; F36L/M50I/S51G/C73R/S107T/K111M/A120V/V131E; M50V/R119W/A120V/T125I/R141G; A109G/A112V/K115E/R119W; Q55R/R76H/A112V/K115I/A120V; W12R/F86Y/R95L/A112V/R119P/T133R; S67N/C73Y/A112V; F17I/S40P/T56S/A112V; W12L/P14S/M50V/S67R/A93V/R94Q/K111T/A112V/R119W/A120V; F36L/L59R/S67N/A105L/A112V/R119W/A120V/A143V; L59M/E64K/F86Y/R94Q/A112V/R119L/A120V/T125I/T133S; P14H/F17Y/T39R/S40T/K58R/V77D/G104V/A112V/Q113R/1114T/A143V; D57V/L59M/P69S/C73S/A112V/R119L/A120V/A134V; V23E/T39S/S40P/C73Y/V91A/R92N/L102F/A112V/R119W/A120V; T16A/F17I/F36L/S67N/C73R/H87L/R92G/R95L/A112V/R119W; C73S/A105V/A112V/R119W/A120V/T133A; P14S/M50L/L59V/R66H/G70S/C73R/A112V/A120V/T125I/G144S; P8T/S40P/S53N/R95L/A112V/A120V/T125I/R128M/P138T/R141G; S37T/T56M/C73S/D85N/A109G/A112V/A120V/H135Y/A143S; S67N/C73R/A93V/G104A/A112V/R119Q/R127S/H135R; S40P/S67N/C73R/A112V/A120V; S67N/C73R/A93V/A112V/R119W; C73R/A93V/A112V/R119W; S67N/C73R/A112V/A120V; N13D/P69H/C73R/A93V/A112V/R119W/R141S; F17I/N38D/S40P/S67N/C73R/A112V/A120V; N13D/F17I/S40P/T56M/R66S/S67N/G70C/A112V/A120V/R141S; S40P/F43L/R66S/S67N/G70C/A112V/R119L/A120V; V23G/S40T/G104A/A112V/R119L/A120V; W12R/F36I/N54Y/S67I/C73S/A93V/G104A/A112V/K115Q/R119W; S40P/M50L/S67I/C73S/R92G/A93V/A112V/A120V/R141S; F17I/T25A/S40P/F43Y/S67N/C73R/F86Y/A112V/R119W/T125I; F17I/S40P/M50L/S67I/C73S/A112V/A120V/E130K/P136L; W12R/S40P/S67N/C73R/A93V/A112V/A120V/R141S; F17I/S40P/M50L/S67I/C73S/R92G/A93V/A112V/A120V/R141S; F17I/S40P/M50L/S67I/A112V/A120V/R141S; V23G/T56P/S67I/C73S/F86Y/R92G/G104A/A112V/R119W/A143D; F17I/S40P/M50L/S67I/C73S/R92G/A93V/A112V/R119W/T125I; D9V/P11A/N13D/S40T/T56M/S67N/R95L/G104A/A112V/R119L/A120V; F17I/T25A/S40P/F43Y/S67N/A112V/R119L/A120V; D9E/F17I/S40P/M50L/S67I/C73S/V90M/T100A/G104A/K111M/A112V/R119W/A120V/A143D; F17I/S40P/M50L/S67I/C73S/R92G/A93V/A112V/A120V/R141G; F17I/S40P/S67N/S89G/R95L/A112V/R119W/T125I; F17I/S40P/M50L/S67I/C73S/R92G/A93V/K111M/A112V/R119Q/A120V; D9N/F17I/T31N/S40P/M50L/S67I/C73S/R92G/A93V/A112V/A120V/R141S; N13D/S40T/T56M/S67N/R95L/G104A/K111R/A112V/A120V/T125I; W12G/F17I/S40P/M50L/A112V/P132T; D9N/F17I/S40P/M50T/T56A/G70S/C73R/R92G/A93V/A112V/A120V/R141S; N38S/L59M/Q71L/S107T/A112V/K115E/R119Q/A120V; M50V/L59M/A112V/R119Q/A120V P81S/F86Y/R92S/S107T/A112V/K115E/A120V; C73R/R84Q/F86Y/S107T/A112V/K115D/A120V; W12G/M50T/S53N/S67R/G70S/C73R/G104V/A112V/K115E/R119W; T31I/F36Y/F43Y/S67N/G70S/C73R/V90M/A112V/R119W; R76S/S107T/K111N/A112V/K115N/A120V; F86Y/A112V/R119W/A120V; N13S/M50I/R76S/S107T/A112V/K115N/R119W/A120V; P14H/T16S/M50L/C73R/R84Q/F86Y/S107T/A112V/K115E/A120V; F17L/T25A/L59M/E64K/F86Y/R94Q/S107T/A112V/K115N/R119W/A120V; Q71R/F86Y/A112V/K115E/R119Q/A120V; R76S/S107T/A112V/K115N/R119W/A120V; M50I/A112V/K115D/A120V; M50V/P81S/F86Y/R92S/S107T/A112V/K115E/A120V; M50I/S67N/G70R/K111T/A112V/R119W/A120V; P14H/T16S/M50L/L80Q/K111M/R119Q/A120V; T31I/F36Y/E64K/A112V/K115E/R119Q/A120V; S107T/A112V/R119W/A120V; T56S/A112V/K115E/A120V; T56S/A112V/R119W; N46I/Y48N/D57Y/S67C/V90L/A112V; T56S/A112V/R119P; P14H/F17I/V44M/A112V/K115E/A120V; N38S/T56S/A112V/K115E/A120V; S42G/M50L/P69S/F86Y/A112V/K115E; P14H/T56S/A112V/K115E/A120V; N13S/S67N/G70C/F86Y/S89N/V91D/A112V/R119L/A120V; W12G/S67N/Q71R/F86Y/K111M/A112V/K115Q/R119W; S67N/C73R/V91D/S107T/K111M/A112V/K115Q/R119W; N13S/M50I/R76S/S107T/K111M/A112V/K115Q/R119W; T33I/S67N/G70S/S107T/K111N/A112V/K115E/R119W; P69L/F86Y/V90M/T100I/S107T/K111N/A112V/K115N/A120V; F17L/T25A/P69L/F86Y/V90M/T100I/S107T/K111N/A112V/K115N/A120V; T33I/M50I/R76S/F86Y/S107T/A112V/K115N/R119W/A120V; N13S/S67N/C73R/F86Y/S107T/A112V/Q113R/K115E/A120V; S67N/C73R/F86Y/V91D/S107T/A112V/K115D/A120V; F17L/T25A/S67N/C73R/R84Q/F86Y/A93V/A112V/K115E/R119W; T56S/A112V/K115E P69L/V91D/A112V/K115N/R119W/A120V; N13S/E41D/M50I/G70V/D72N/F86Y/R94Q/A112V/R119L/A120V; M50I/P69L/F86Y/V90M/T100I/S107T/K111N/A112V/K115N/A120V; M50I/C73R/S107T/K111N/A112V/K115N/A120V; F86Y/A112V/K115N/R119W; M50I/S67N/C73R/F86Y/R95L/S107T/A112V/K115N/R119W; M50L/Q68R/P69S/F86Y/S107T/A112V/K115N/R119W; N38T/A112V/K115N/R119L/A120V; S67N/Q71H/F86Y/R95L/S107T/A112V/K115N/R119W; A20T/D28E/F36L/M50I/Q68R/P69S/F86Y/A112V/R119L/A120V; M50I/S67N/C73R/F86Y/R95L/A112V/Q113W/R119L/A120V; L59M/S67N/Q71L/C73R/R95L/S107T/A112V/K115N/R119W; P52L/S53N/C73S/A112V/E116D/R119W; Q71R/C73R/A112V/K115N/R119L/A120V; W12L/A20T/N29D/S37P/L59M/Q68R/P69S/F86Y/A112V/R119L/A120V; N46I/Y48F/D57V/P69L/A112V/K115N/R119W; M50I/S67N/C73R/F86Y/R95L/S107T/A112V/K115Q/R119Q/A120V; N54D/P69H/C73R/F86Y/R95L/S107T/A112V/K115N/R119W; T56S/Q71K/F86Y/R95L/S107T/A112V/K115N/R119W; C73A/F86Y/S107T/A112V/K115N/R119Q/A120V; C73R/F86Y/A105G/S107T/A112V/K115N/R119L/A120V; N54H/G70E/C73P/F86Y/A112V/K115D/R119L/A120V; C73G/

F86Y/S107T/A112V/K115N/R119Q/A120V; N54S/C73G/F86Y/S107T/A112V/K115D/R119L/A120V; F86Y/S107T/A112V/K115D/R119W/A120V; G70E/C73P/F86Y/S107T/A112V/K115E/R119Q/A120V; C73G/F86Y/A105G/S107T/A112V/K115D/R119W; C73G/F86Y/S107T/A112V/K115D/R119L/A120V; C73S/F86Y/S107T/A112V/K115D/R119L/A120V; L45V/C73G/F86Y/G104A/S107T/A112V/K115N/R119W/A120V; C73P/F86Y/S107T/A112V/K115D/R119Q/A120V; C73S/F86Y/S107T/A112V/K115E/R119Q/A120V; C73S/F86Y/G104T/S107T/A112V/K115E/R119W/A120V; C73R/F86Y/S107T/K111R/A112V/K115D/A120V; P14L/C73G/F86Y/S107T/A112V/K115D/R119L/A120V; G70E/F86Y/S107T/A112V/K115D/R119L/A120V; C73G/F86Y/G104V/S107T/A112V/K115N/R119L/A120V; C73S/F86Y/G104S/S107T/L108F/A112V/K115D/R119L/A120V; C73S/F86Y/S107T/A112V/K115D/A120V; C73R/F86Y/S107T/A112V/K115D/R119L/A120V; C73S/F86Y/S107T/A112V/Q113R/K115D/R119L/A120V; C73S/F86Y/V91A/S107T/A112V/K115D/R119L/A120V; G70E/C73P/F86Y/A105G/S107T/A112V/K115D/R119Q/A120V; C73G/F86Y/A105G/S107T/A112V/K115D/R119L/A120V; C73G/F86Y/A105G/S107T/A112V/Q113R/K115D/R119L/A120V; F86Y/S107T/A112V/K115D/R119Q/A120V; C73R/F86Y/S107T/A112V/K115N/R119L/A120V; C73A/F86Y/S107T/A112V/Q113R/K115E/R119Q/A120V; C73R/F86Y/S107T/A112V/K115D/R119Q/A120V; C73G/F86Y/A112V/K115D/R119W/A120V; C73P/F86Y/A105G/S107T/A112V/Q113R/K115D/R119L/A120V; C73R/F86Y/A105G/S107T/A112V/K115D/R119L/A120V; C73A/F86Y/S107T/A112V/K115D/R119L/A120V; P69S/C73R/F86Y/S107T/A112V/K115D/R119W/A120V; C73S/F86Y/G104S/S107T/A112V/K115E/R119W/A120V; Q68R/C73S/F86Y/S107T/A112V/K115D/R119Q/A120V; C73R/F86Y/S107T/A112V/K115N/R119Q/A120V; G70E/C73R/F86Y/S107T/A112V/K115N/R119Q/A120V; C73S/F86Y/S107T/A112V/K115D/R119W/A120V; G70E/F86Y/G104T/I106L/S107T/L108T/A112V/K115N/R119L/A120V; C73H/F86Y/A105G/S107T/A112V/K115D/R119L/A120V; G70E/C73P/F86Y/A105C/S107T/A112V/K115D/R119L/A120V; G70E/C73P/F86Y/S107T/A112V/K115D/R119Q/A120V; C73S/F86Y/S107T/K111R/A112V/K115E/R119L/A120V; C73R/D85G/F86Y/A105G/S107T/A112V/K115D/R119Q/A120V; C73R/F86Y/S107T/A112V/K115E/R119W/A120V; N54S/C73G/F86Y/S107T/A112V/K115E/R119Q/A120V; C73S/F86Y/G104S/S107T/A112V/K115N/R119L/A120V; F17L/Q71R/C73G/F86Y/A105G/S107T/A112V/K115D/R119L/A120V; C73G/F86Y/S107T/A112V/K115E/R119W/A120V; G70E/C73G/F86Y/A105C/S107T/A112V/K115E/R119L/A120V; C73G/F86Y/G104A/S107T/A112V/K115D/R119W/A120V; C73S/F86Y/S107T/A112V/K115N/A120V; C73P/F86Y/S107T/A112V/K115N/R119L/A120V; W12R/F86Y/S107T/A112V/K115D/R119Q/A120V; G70E/C73G/F86Y/A105L/A112V/K115N/R119Q/A120V; or F86Y/S107T/A112V/K115N/R119W/A120V, with reference to numbering of positions set forth in SEQ ID NO:37.

3. The variant PD-1 polypeptide of claim 1, wherein the variant PD-1 polypeptide is or comprises the IgV domain.

4. The variant PD-1 polypeptide of claim 1, wherein the variant PD-1 exhibits increased binding to the ectodomain of human PD-L1 compared to the binding affinity of the unmodified PD-1 for the ectodomain of human PD-L1.

5. An immunomodulatory protein comprising a variant PD-1 polypeptide of claim 1 linked to a multimerization domain.

6. The immunomodulatory protein of claim 5, wherein the multimerization domain is an Fc domain or is a variant Fc domain with reduced effector function.

7. A conjugate, comprising a variant PD-1 polypeptide of claim 1 linked to a targeting moiety that specifically binds to a molecule on the surface of a cell.

8. An engineered cell, comprising a variant PD-1 polypeptide of claim 1; an immunomodulatory protein comprising a variant PD-1 polypeptide of claim 1, or a conjugate comprising a variant PD-1 polypeptide of claim 1.

9. An infectious agent, comprising a variant PD-1 polypeptide of claim 1, an immunomodulatory protein comprising a variant PD-1 polypeptide of claim 1, or a conjugate comprising a variant PD-1 polypeptide of claim 1.

10. A pharmaceutical composition, comprising a variant PD-1 polypeptide of claim 1, an immunomodulatory protein comprising a variant PD-1 polypeptide of claim 1, a conjugate comprising a variant PD-1 polypeptide of claim 1, or an engineered cell comprising a transmembrane protein comprising a variant PD-1 polypeptide of claim 1.

11. An article of manufacture comprising the pharmaceutical composition of claim 10 in a vial or a container.

* * * * *